(12) United States Patent
Grant et al.

(10) Patent No.: US 10,322,151 B2
(45) Date of Patent: Jun. 18, 2019

(54) COMPOSITIONS COMPRISING BACTERIAL STRAINS

(71) Applicant: 4D Pharma Research Limited, Aberdeen (GB)

(72) Inventors: George Grant, Aberdeen (GB); Angela Margaret Patterson, Norwich (GB); Imke Mulder, Aberdeen (GB); Seanin McCluskey, Aberdeen (GB); Emma Raftis, Leeds (GB)

(73) Assignee: 4D PHARMA RESEARCH LIMITED (GB)

( * ) Notice: Subject to any disclaimer, the term of this patent is extended or adjusted under 35 U.S.C. 154(b) by 0 days.

(21) Appl. No.: 15/673,270

(22) Filed: Aug. 9, 2017

(65) Prior Publication Data

US 2017/0360856 A1 Dec. 21, 2017

Related U.S. Application Data

(63) Continuation of application No. PCT/GB2016/051770, filed on Jun. 15, 2016.

(30) Foreign Application Priority Data

| Jun. 15, 2015 | (GB) | ................................. | 1510466.4 |
| Nov. 20, 2015 | (GB) | ................................. | 1520508.1 |
| Apr. 19, 2016 | (GB) | ................................. | 1606810.8 |

(51) Int. Cl.
| *A61K 35/747* | (2015.01) |
| *C07K 14/54* | (2006.01) |
| *C07K 16/24* | (2006.01) |
| *A61K 38/00* | (2006.01) |
| *C12R 1/01* | (2006.01) |
| *A61K 35/74* | (2015.01) |

(52) U.S. Cl.
CPC ............ *A61K 35/747* (2013.01); *A61K 35/74* (2013.01); *C07K 14/54* (2013.01); *C07K 16/24* (2013.01); *C12R 1/01* (2013.01); *A61K 38/00* (2013.01)

(58) Field of Classification Search
None
See application file for complete search history.

(56) References Cited

U.S. PATENT DOCUMENTS

| 3,817,837 A | 6/1974 | Rubenstein et al. |
| 3,850,752 A | 11/1974 | Schuurs et al. |
| 3,939,350 A | 2/1976 | Kronick et al. |
| 3,996,345 A | 12/1976 | Ullman et al. |
| 4,275,149 A | 6/1981 | Litman et al. |
| 4,277,437 A | 7/1981 | Maggio et al. |
| 4,366,241 A | 12/1982 | Tom et al. |
| 4,683,202 A | 7/1987 | Mullis et al. |
| 4,816,567 A | 3/1989 | Cabilly et al. |
| 5,589,168 A | 12/1996 | Allen et al. |
| 5,674,707 A | 10/1997 | Hintz et al. |
| 5,741,665 A | 4/1998 | Kato et al. |
| 5,925,657 A | 7/1999 | Seed et al. |
| 6,348,452 B1 | 2/2002 | Brown et al. |
| 6,468,964 B1 | 10/2002 | Rowe et al. |
| 6,645,530 B1 | 11/2003 | Borody |
| 7,625,704 B2 | 12/2009 | Fredricks et al. |
| 7,749,494 B2 | 7/2010 | Renaud et al. |
| 7,998,474 B2 | 8/2011 | Kelly |
| 8,197,805 B2 | 6/2012 | Lin et al. |
| 8,287,932 B2 | 10/2012 | Rosales et al. |
| 8,460,648 B2 | 6/2013 | Borody |
| 8,557,233 B2 | 10/2013 | Macsharry et al. |
| 9,011,834 B1 | 4/2015 | McKenzie et al. |
| 9,314,489 B2 | 4/2016 | Kelly et al. |
| 9,371,510 B2 | 6/2016 | Moore |
| 9,376,473 B2 | 6/2016 | Gleiberman et al. |
| 9,539,293 B2 | 1/2017 | Kelly et al. |
| 9,610,307 B2 * | 4/2017 | Berry .................. A61K 9/0031 |
| 9,662,381 B2 | 5/2017 | Honda et al. |
| 9,796,762 B2 | 10/2017 | Kelly et al. |
| 9,808,519 B2 | 11/2017 | Honda et al. |
| 9,839,655 B2 | 12/2017 | Mulder et al. |
| 9,855,302 B2 | 1/2018 | Gajewski et al. |
| 9,974,815 B2 | 5/2018 | Mulder et al. |
| 9,987,311 B2 | 6/2018 | Mulder et al. |
| 10,046,015 B2 | 8/2018 | Mulder et al. |
| 10,058,574 B2 | 8/2018 | Grant et al. |
| 10,080,772 B2 | 9/2018 | Crouzet et al. |
| 10,086,020 B2 | 10/2018 | Bernalier-Donadille et al. |
| 10,086,021 B2 | 10/2018 | Jeffery et al. |
| 10,086,022 B2 | 10/2018 | Bernalier-Donadille et al. |

(Continued)

FOREIGN PATENT DOCUMENTS

| CN | 1863540 A | 11/2006 |
| CN | 1917946 A | 2/2007 |

(Continued)

OTHER PUBLICATIONS

Chiu, et al., Monocolonization of germ-free mice with bacteroides fragilis protects against dectran sulfate sodium-induced acute colitis. Biomed Research International 2014. vol. 2014. Article ID 675786. 9 Pages.

Fenner, et al., *Bacteroides massiliensis* sp. nov., isolated from blood culture of a newborn. International Journal of systematic and evolutionary microbiology, 2005. 55: 1335-1337.

Hougee, et al., Oral treatment with probiotics reduces allergic symptoms in ovalbumin-sensitized mice:a bacterial strain comparative study. Int Arch Allergy Immunol. 2010; 151:107-117.

(Continued)

*Primary Examiner* — Robert A Zeman
(74) *Attorney, Agent, or Firm* — Wilson Sonsini Goodrich Roasti

(57) ABSTRACT

The invention provides compositions comprising bacterial strains for treating and preventing inflammatory and autoimmune diseases.

14 Claims, 76 Drawing Sheets

Specification includes a Sequence Listing.

(56) References Cited

U.S. PATENT DOCUMENTS

| | | | |
|---|---|---|---|
| 10,086,023 | B2 | 10/2018 | Bernalier-Donadille et al. |
| 2003/0147858 | A1 | 8/2003 | Renaud et al. |
| 2004/0106564 | A1 | 6/2004 | Nilius et al. |
| 2006/0073161 | A1 | 4/2006 | Breton |
| 2007/0286913 | A1 | 12/2007 | Swain et al. |
| 2008/0069861 | A1 | 3/2008 | Brown et al. |
| 2008/0206212 | A1 | 8/2008 | McMahon et al. |
| 2008/0299098 | A1 | 12/2008 | Se et al. |
| 2010/0047209 | A1 | 2/2010 | Stanton et al. |
| 2010/0247489 | A1 | 9/2010 | Saur-Brosch |
| 2010/0284973 | A1 | 11/2010 | Schiffer-Mannioui et al. |
| 2010/0303782 | A1 | 12/2010 | Cobb et al. |
| 2010/0311686 | A1 | 12/2010 | Kasper et al. |
| 2010/0316617 | A1 | 12/2010 | Renaud et al. |
| 2011/0053829 | A1 | 3/2011 | Baumhof et al. |
| 2011/0086011 | A1 | 4/2011 | Kasper et al. |
| 2012/0020943 | A1 | 1/2012 | Lin |
| 2012/0107279 | A1 | 5/2012 | Arigoni et al. |
| 2013/0022575 | A1 | 1/2013 | Cassity et al. |
| 2013/0130988 | A1 | 5/2013 | Blareau et al. |
| 2013/0195802 | A1 | 8/2013 | Moore |
| 2013/0280724 | A1 | 10/2013 | Ramadan et al. |
| 2013/0316032 | A1 | 11/2013 | Itoh et al. |
| 2013/0336931 | A1 | 12/2013 | Wadström et al. |
| 2014/0037716 | A1 | 2/2014 | Nowill et al. |
| 2014/0056852 | A1 | 2/2014 | Guglielmetti et al. |
| 2014/0112897 | A1 | 4/2014 | Pyne et al. |
| 2014/0147425 | A1 | 5/2014 | Henn et al. |
| 2014/0154218 | A1 | 6/2014 | Kohno et al. |
| 2014/0193464 | A1 | 7/2014 | Lin et al. |
| 2014/0199281 | A1 | 7/2014 | Henn et al. |
| 2014/0227227 | A1 | 8/2014 | Qin et al. |
| 2014/0328803 | A1 | 11/2014 | McKenzie et al. |
| 2014/0335131 | A1 | 11/2014 | Mazmanian et al. |
| 2014/0341921 | A1 | 11/2014 | Honda et al. |
| 2014/0363397 | A1 | 12/2014 | Allen-Vercoe et al. |
| 2015/0044173 | A1 | 2/2015 | Jones et al. |
| 2015/0071957 | A1 | 3/2015 | Kelly et al. |
| 2015/0104418 | A1 | 4/2015 | Flint et al. |
| 2015/0132264 | A1 | 5/2015 | Kelly et al. |
| 2015/0284781 | A1 | 10/2015 | Klumpp et al. |
| 2016/0058804 | A1 | 3/2016 | Jones et al. |
| 2016/0067188 | A1 | 3/2016 | Cade et al. |
| 2016/0184370 | A1 | 6/2016 | McKenzie et al. |
| 2016/0199424 | A1 | 7/2016 | Berry et al. |
| 2016/0223553 | A1 | 8/2016 | Sears et al. |
| 2016/0279177 | A1 | 9/2016 | Kelly et al. |
| 2017/0143772 | A1 | 5/2017 | Mulder et al. |
| 2017/0143773 | A1 | 5/2017 | Mulder et al. |
| 2017/0143774 | A1 | 5/2017 | Mulder et al. |
| 2017/0143775 | A1 | 5/2017 | Mulder et al. |
| 2017/0173089 | A1 | 6/2017 | Kelly |
| 2017/0354695 | A1 | 12/2017 | Grant et al. |
| 2018/0078587 | A1 | 3/2018 | Crott et al. |
| 2018/0133265 | A1 | 5/2018 | Stevenson |

FOREIGN PATENT DOCUMENTS

| | | |
|---|---|---|
| CN | 1954066 A | 4/2007 |
| CN | 101590081 A | 12/2009 |
| CN | 102304483 A | 1/2012 |
| CN | 102031235 B | 7/2012 |
| CN | 102093967 B | 1/2013 |
| CN | 102905558 A | 1/2013 |
| CN | 102940652 A | 2/2013 |
| CN | 102373172 B | 3/2013 |
| CN | 103037876 A | 4/2013 |
| CN | 103142656 A | 6/2013 |
| CN | 103146620 A | 6/2013 |
| CN | 103156888 A | 6/2013 |
| CN | 103652322 A | 3/2014 |
| CN | 103781487 A | 5/2014 |
| CN | 103820363 A | 5/2014 |
| CN | 103849590 A | 6/2014 |
| CN | 103865846 A | 6/2014 |
| CN | 103981115 A | 8/2014 |
| CN | 103981117 A | 8/2014 |
| CN | 104160014 A | 11/2014 |
| CN | 104195075 A | 12/2014 |
| CN | 103509741 B | 2/2015 |
| CN | 102940652 B | 3/2015 |
| CN | 104435000 A | 3/2015 |
| CN | 103037876 B | 4/2015 |
| CN | 104546932 A | 4/2015 |
| CN | 104546933 A | 4/2015 |
| CN | 104546934 A | 4/2015 |
| CN | 104546935 A | 4/2015 |
| CN | 104546940 A | 4/2015 |
| CN | 104546942 A | 4/2015 |
| CN | 104560820 A | 4/2015 |
| CN | 105112333 A | 12/2015 |
| CN | 103820363 B | 2/2016 |
| CN | 103865846 B | 3/2016 |
| CN | 105982919 A | 10/2016 |
| DE | 19826928 A1 | 12/1999 |
| DE | 10206995 A1 | 9/2003 |
| EP | 0120516 A2 | 10/1984 |
| EP | 0238023 A2 | 9/1987 |
| EP | 0449375 A2 | 10/1991 |
| EP | 0581171 A1 | 2/1994 |
| EP | 0778778 A1 | 6/1997 |
| EP | 1141235 A2 | 10/2001 |
| EP | 1227152 A1 | 7/2002 |
| EP | 1448995 A1 | 8/2004 |
| EP | 1481681 A1 | 12/2004 |
| EP | 1675481 B1 | 11/2008 |
| EP | 1997499 A1 | 12/2008 |
| EP | 1997905 A1 | 12/2008 |
| EP | 1997906 A1 | 12/2008 |
| EP | 1997907 A1 | 12/2008 |
| EP | 2133088 A3 | 1/2010 |
| EP | 1280541 B2 | 3/2010 |
| EP | 2308498 A1 | 4/2011 |
| EP | 2217253 B1 | 6/2011 |
| EP | 1940243 B1 | 8/2011 |
| EP | 2359838 A1 | 8/2011 |
| EP | 1855550 B1 | 10/2011 |
| EP | 1871400 B1 | 10/2011 |
| EP | 2124972 B1 | 6/2012 |
| EP | 1773361 B2 | 9/2012 |
| EP | 1945234 B1 | 12/2012 |
| EP | 2323493 B8 | 12/2012 |
| EP | 2323494 B8 | 12/2012 |
| EP | 1629850 B2 | 5/2013 |
| EP | 2203551 B1 | 8/2013 |
| EP | 2140771 B1 | 12/2013 |
| EP | 2687227 A1 | 1/2014 |
| EP | 2179028 B1 | 8/2014 |
| EP | 2650002 A4 | 8/2014 |
| EP | 2164349 B1 | 9/2014 |
| EP | 2134835 B1 | 10/2014 |
| EP | 2810652 A2 | 12/2014 |
| EP | 2305838 B1 | 1/2015 |
| EP | 2832859 A1 | 2/2015 |
| ES | 2408279 A2 | 6/2013 |
| JP | H08259450 A | 10/1996 |
| JP | 2003261453 A | 9/2003 |
| JP | 2005097280 A | 4/2005 |
| JP | 2006265212 A | 10/2006 |
| JP | 2007084533 A | 4/2007 |
| JP | 2007116991 A | 5/2007 |
| JP | 2008195635 A | 8/2008 |
| JP | 2009507023 A | 2/2009 |
| JP | 2010246523 A | 11/2010 |
| JP | 5031249 B2 | 9/2012 |
| JP | 2013005759 A | 1/2013 |
| JP | 5183848 B2 | 4/2013 |
| JP | 2013527240 A | 6/2013 |
| JP | 2013201912 A | 10/2013 |
| JP | 2014196260 A | 10/2014 |
| JP | 2014534957 A | 12/2014 |
| JP | 2015500792 A | 1/2015 |
| JP | 5710876 B2 | 4/2015 |
| JP | 5792105 B2 | 10/2015 |

(56) References Cited

FOREIGN PATENT DOCUMENTS

| | | |
|---|---|---|
| KR | 100468522 B1 | 1/2005 |
| KR | 20100128168 A | 12/2010 |
| KR | 1020100128168 | 12/2010 |
| KR | 101017448 B1 | 2/2011 |
| KR | 101057357 B1 | 8/2011 |
| KR | 20130021764 A | 3/2013 |
| KR | 101250463 B1 | 4/2013 |
| KR | 20140037544 A | 3/2014 |
| KR | 20140061328 A | 5/2014 |
| PL | 229020 B1 | 5/2018 |
| RU | 2078815 C1 | 5/1997 |
| TW | I417054 B | 12/2013 |
| WO | WO-9117243 A1 | 11/1991 |
| WO | WO-9720577 A1 | 6/1997 |
| WO | WO-9730717 A1 | 8/1997 |
| WO | WO-9735956 A1 | 10/1997 |
| WO | WO-9843081 A1 | 10/1998 |
| WO | WO-9855131 A1 | 12/1998 |
| WO | WO-9857631 A1 | 12/1998 |
| WO | WO-9919459 A1 | 4/1999 |
| WO | WO-9942568 A1 | 8/1999 |
| WO | WO-9945955 A1 | 9/1999 |
| WO | WO-0116120 A1 | 3/2001 |
| WO | WO-0158275 A2 | 8/2001 |
| WO | WO-0185187 A1 | 11/2001 |
| WO | WO-0193904 A1 | 12/2001 |
| WO | WO-0207741 A1 | 1/2002 |
| WO | WO-02070670 A1 | 9/2002 |
| WO | WO-02085933 A1 | 10/2002 |
| WO | WO-02094296 A1 | 11/2002 |
| WO | WO-03010297 A1 | 2/2003 |
| WO | WO-03022255 A2 | 3/2003 |
| WO | WO-03045317 A2 | 6/2003 |
| WO | WO-03046580 A1 | 6/2003 |
| WO | WO-03053220 A2 | 7/2003 |
| WO | WO-2004003235 A3 | 6/2004 |
| WO | WO-2005007834 A1 | 1/2005 |
| WO | WO-2005030133 A2 | 4/2005 |
| WO | WO-2005032567 A2 | 4/2005 |
| WO | WO-2005058335 A1 | 6/2005 |
| WO | WO-2005032567 A3 | 7/2005 |
| WO | WO-2005107381 A2 | 11/2005 |
| WO | WO-2006033951 A1 | 3/2006 |
| WO | WO-2006102350 A1 | 9/2006 |
| WO | WO-2006102536 A2 | 9/2006 |
| WO | WO-2006091103 A3 | 10/2006 |
| WO | WO-2006130205 A1 | 12/2006 |
| WO | WO-2007027761 A2 | 3/2007 |
| WO | WO-2007098371 A2 | 8/2007 |
| WO | WO-2007136719 A2 | 11/2007 |
| WO | WO-2007140230 A3 | 2/2008 |
| WO | WO-2008031438 A3 | 5/2008 |
| WO | WO-2008055703 A2 | 5/2008 |
| WO | WO-2008064489 A1 | 6/2008 |
| WO | WO-2008053444 A3 | 7/2008 |
| WO | WO-2008134450 A2 | 11/2008 |
| WO | WO-2008153377 A1 | 12/2008 |
| WO | WO-2009027753 A1 | 3/2009 |
| WO | WO-2009030481 A1 | 3/2009 |
| WO | WO-2009055362 A1 | 4/2009 |
| WO | WO-2009072889 A1 | 6/2009 |
| WO | WO-2009079564 A2 | 6/2009 |
| WO | WO-2009043856 A3 | 7/2009 |
| WO | WO-2009100331 A2 | 8/2009 |
| WO | WO-2009128949 A2 | 10/2009 |
| WO | WO-2009151315 A1 | 12/2009 |
| WO | WO-2009154463 A2 | 12/2009 |
| WO | WO-2009156301 A1 | 12/2009 |
| WO | WO-2010002241 A1 | 1/2010 |
| WO | WO-2010037408 A1 | 4/2010 |
| WO | WO-2010037539 A1 | 4/2010 |
| WO | WO-2010048481 A1 | 4/2010 |
| WO | WO-2010063601 A1 | 6/2010 |
| WO | WO-2010081126 A3 | 9/2010 |
| WO | WO-2010129839 A1 | 11/2010 |
| WO | WO-2010130659 A1 | 11/2010 |
| WO | WO-2010130660 A1 | 11/2010 |
| WO | WO-2010130662 A1 | 11/2010 |
| WO | WO-2010130663 A1 | 11/2010 |
| WO | WO-2010130697 A1 | 11/2010 |
| WO | WO-2010130699 A1 | 11/2010 |
| WO | WO-2010130700 A1 | 11/2010 |
| WO | WO-2010130701 A1 | 11/2010 |
| WO | WO-2010130702 A1 | 11/2010 |
| WO | WO-2010130704 A1 | 11/2010 |
| WO | WO-2010130710 A1 | 11/2010 |
| WO | WO-2010130713 A1 | 11/2010 |
| WO | WO-2010/143940 A1 | 12/2010 |
| WO | WO-2010139531 A1 | 12/2010 |
| WO | WO-2010142504 A1 | 12/2010 |
| WO | WO-2010143961 A1 | 12/2010 |
| WO | WO-2010147714 A1 | 12/2010 |
| WO | WO-2010133475 A3 | 1/2011 |
| WO | WO-2011000620 A1 | 1/2011 |
| WO | WO-2011000621 A1 | 1/2011 |
| WO | WO-2011005756 A1 | 1/2011 |
| WO | WO-2010133472 A3 | 2/2011 |
| WO | WO-2011020748 A1 | 2/2011 |
| WO | WO-2011036539 A1 | 3/2011 |
| WO | WO-2011043654 A1 | 4/2011 |
| WO | WO-2011044208 A1 | 4/2011 |
| WO | WO-2011058535 A1 | 5/2011 |
| WO | WO-2011096808 A1 | 8/2011 |
| WO | WO-2011096809 A1 | 8/2011 |
| WO | WO-2011110918 A1 | 9/2011 |
| WO | WO-2011121379 A1 | 10/2011 |
| WO | WO-2011149335 A1 | 12/2011 |
| WO | WO-2011152566 A2 | 12/2011 |
| WO | WO-2011153226 A2 | 12/2011 |
| WO | WO-2011157816 A1 | 12/2011 |
| WO | WO-2012024638 A2 | 2/2012 |
| WO | WO-2011153226 A3 | 3/2012 |
| WO | WO-2012062780 A1 | 5/2012 |
| WO | WO-2012071380 A1 | 5/2012 |
| WO | WO-2012105312 A1 | 8/2012 |
| WO | WO-2012140636 A1 | 10/2012 |
| WO | WO-2012142605 A1 | 10/2012 |
| WO | WO-2012145491 A2 | 10/2012 |
| WO | WO-2012158517 A1 | 11/2012 |
| WO | WO-2012165843 A2 | 12/2012 |
| WO | WO-2013005836 A1 | 1/2013 |
| WO | WO-2013008039 A2 | 1/2013 |
| WO | WO-2013037068 A1 | 3/2013 |
| WO | WO-2013050792 A1 | 4/2013 |
| WO | WO-2013053836 A1 | 4/2013 |
| WO | WO-2013080561 A1 | 6/2013 |
| WO | WO-2013124725 A1 | 8/2013 |
| WO | WO-2013144701 A1 | 10/2013 |
| WO | WO-2013153358 A1 | 10/2013 |
| WO | WO-2013154725 A1 | 10/2013 |
| WO | WO-2013181694 A1 | 12/2013 |
| WO | WO-2014001368 A1 | 1/2014 |
| WO | WO-2014020004 A1 | 2/2014 |
| WO | WO-2014032108 A1 | 3/2014 |
| WO | WO-2014036182 A2 | 3/2014 |
| WO | WO-2014043593 A2 | 3/2014 |
| WO | WO-2014064359 A1 | 5/2014 |
| WO | WO-2014067976 A1 | 5/2014 |
| WO | WO-2014070225 A1 | 5/2014 |
| WO | WO-2014075745 A1 | 5/2014 |
| WO | WO-2014078911 A1 | 5/2014 |
| WO | WO-2014082050 A1 | 5/2014 |
| WO | WO-2014121298 A2 | 8/2014 |
| WO | WO-2014121301 A1 | 8/2014 |
| WO | WO-2014121302 A2 | 8/2014 |
| WO | WO-2014121304 A1 | 8/2014 |
| WO | WO-2014130540 A1 | 8/2014 |
| WO | WO-2014137211 A1 | 9/2014 |
| WO | WO-2014145958 A2 | 9/2014 |
| WO | WO-2014150094 A1 | 9/2014 |
| WO | WO-2014152338 A1 | 9/2014 |
| WO | WO-2014153194 A2 | 9/2014 |
| WO | WO-2014121302 A3 | 10/2014 |
| WO | WO-2014167338 A1 | 10/2014 |

(56) References Cited

FOREIGN PATENT DOCUMENTS

| WO | WO-2014182966 A1 | 11/2014 |
|---|---|---|
| WO | WO-2014200334 A1 | 12/2014 |
| WO | WO-2014201037 A2 | 12/2014 |
| WO | WO-2015003001 A1 | 1/2015 |
| WO | WO-2015006355 A2 | 1/2015 |
| WO | WO-2015013214 A2 | 1/2015 |
| WO | WO-2015017625 A1 | 2/2015 |
| WO | WO-2015021936 A1 | 2/2015 |
| WO | WO-201503305 A1 | 3/2015 |
| WO | WO-2015038731 A1 | 3/2015 |
| WO | WO-2015057151 A1 | 4/2015 |
| WO | WO-2015077794 A1 | 5/2015 |
| WO | WO-2015095241 A2 | 6/2015 |
| WO | WO-2015077794 A4 | 7/2015 |
| WO | WO-2015156419 A1 | 10/2015 |
| WO | WO-2015156519 A1 | 10/2015 |
| WO | WO-2015168534 A1 | 11/2015 |
| WO | WO-2015169944 A1 | 11/2015 |
| WO | WO-2015095241 A4 | 12/2015 |
| WO | WO-2016019506 A1 | 2/2016 |
| WO | WO-2016033439 A2 | 3/2016 |
| WO | WO-2016036615 A1 | 3/2016 |
| WO | WO-2016057671 A1 | 4/2016 |
| WO | WO-2016065324 A1 | 4/2016 |
| WO | WO-2016069795 A2 | 5/2016 |
| WO | WO-2016069801 A1 | 5/2016 |
| WO | WO-2016070151 A1 | 5/2016 |
| WO | WO-2016086161 A1 | 6/2016 |
| WO | WO-2016086205 A2 | 6/2016 |
| WO | WO-2016086206 A1 | 6/2016 |
| WO | WO-2016086208 A1 | 6/2016 |
| WO | WO-2016086209 A1 | 6/2016 |
| WO | WO-2016086210 A1 | 6/2016 |
| WO | WO-2016102950 A1 | 6/2016 |
| WO | WO-2016102951 A1 | 6/2016 |
| WO | WO-2016118730 A1 | 7/2016 |
| WO | WO-2016139217 A1 | 9/2016 |
| WO | WO-2016149449 A1 | 9/2016 |
| WO | WO-2016149687 A1 | 9/2016 |
| WO | WO-2016203218 A1 | 12/2016 |
| WO | WO-2016203220 A1 | 12/2016 |
| WO | WO-2017091753 A1 | 6/2017 |
| WO | WO-2017148596 A1 | 9/2017 |
| WO | WO-2018011594 A1 | 1/2018 |
| WO | WO-(2018/112365 A2 | 6/2018 |
| WO | WO-2018112363 | 6/2018 |
| WO | WO-2018112363 A1 | 6/2018 |
| WO | WO-2018112365 A2 | 6/2018 |

OTHER PUBLICATIONS

Lyons, et al., Bacterial strain-specific induction of Foxp3 T regulatory cells is protective in murine allergy models. Clinical & Experimental Allergy. 2010; 40:811-819.
Macsharry et al., Immunomodulatory effects of feeding with bifidobacterium longum on allergen-induced lung inflammation in the mouse. Pulmonary pharmacology & Therapeutics. 2012; 25:325-334.
Miyake, et al., Phylogenetic analysis of the genus *Bifidobacterium* and related genera based on 16S rDNA sequences. Microbiol. Immunol. 1998; 42(10): 661-667.
Miyauchi, E., Control of multiple sclerosis by gut microbiota. Journal of clinical and experimental medicine. 2015. vol. 253 No. 5.2, pp. 445-450.
Notice of Allowance dated Nov. 22, 2017 for U.S. Appl. No. 15/359,988.
Office Action dated Nov. 2, 2017 for U.S. Appl. No. 15/700,007.
Office Action dated Nov. 24, 2017 for U.S. Appl. No. 15/359,972.
Office Action dated Nov. 24, 2017 for U.S. Appl. No. 15/679,857.
Office Action dated Dec. 6, 2017 for U.S. Appl. No. 15/592,178.
Parabacteroides distasonis (Eggerth and Gagnon) Sakamoto and Benno (ATCC 8503). Sep. 19, 2017. 2 Pages.
Sagar, et al., Bifidobacterium breve and lactobacillus rhamnosus treatment is as effective as budesonide at reducing inflammation in a murine model for chronic asthma. Respiratory Research. 2014; 15(46):1-17.
Schouten, et al., Cow milk allergy symptoms are reduced in mice fed dietary synbiotics during oral sensitization with whey. Nutritional Immunology. 2015; 139(7):1390-403.
Tanaka, K. and Watanabe, K., In Vitro tebipenem activity against anaerobic bacteria. Japanese Journal of Chemotherapy. Mar. 2009. vol. 57 S-1.
Van De Veerdonk, et al., The Anti-CD20 antibody rituximab reduces the Th17 cell response. Arthritis & Rheumatism. Jun. 2011; 63(6):1507-1516.
Zhu, S. and Qian, Y., IL-17/IL-17 receptor system in autoimmune disease: mechanisms and therapeutic potential. Clinical Science (2012) 122, 487-511.
"Amedei, A. et al. Multiple sclerosis: the role of cytokines in pathogenesis and in therapies. Int J Mol Sci. Oct. 19, 2012;13(10):13438-60. doi: 10.3390/ijms131013438."
Arenberg, et al., Interferon-y-inducible Protein 10 (IP-10) Is an Angiostatic Factor That Inhibits Human Non-small Cell Lung Cancer (NSCLC) Tumorigenesis and Spontaneous Metastases. 1996. J. Exp.Med. 184:981-92.
Atarashi et al., Th17 Cell Induction by Adhesion of Microbes to Intestinal Epithelial Cells. Cell, vol. 163, No. 2, Oct. 8, 2015. pp. 367-380.
Atarashi, K. et al., Treg induction by a rationally selected mixture of Clostridia strains from the human microbiota. Nature. 2013; 500(7461):232-236.
Atlas, R. Handbook of Microbiological Media, Fourth Edition. CRC Press. 2010.
Ausubel, et al. Current Protocols in Molecular Biology. 1987. Supplement 30.
Ausubel et al., Short protocols in molecular biology. Fifth edition, 2002.
Azad, M.B. et al., Probiotic supplementation during pregnancy or infancy for the prevention of asthma and wheeze: systematic review and meta-analysis BMJ 2013; 347 :f6471.
Bagge, et al., Diversity of spore-forming bacteria in cattle manure, slaughterhouse waste and samples from biogas plants. Journal of applied microbiology. 2010;109: 1549-1565.
Balato, et al., Effects of adalimumab therapy in adult subjects with moderate-to-severe psoriasis on Th17 pathway. (2014) J Eur Acad Dermatol Venereol. 28(8):1016-24.
Bertram, J. et al. Establishment of a cloned line of Lewis lung carcinoma cells adapted to cell culture. (1980) Cancer let. 11:63-73.
Birdi, K.S. Handbook of Surface and Colloid Chemistry, 2nd Edition. CRC Press. 1997.
Bottacini, et al., Comparative genomics of the Bifidobacterium brevetaxon. BMC Genomics, 2014; 15:170. DOI:10.1186/1471-1471-2164-15-170.
Brand et al., Collagen-induced arthritis, 2007; Protocol 2(5):1269-1275.
Busing, K. et al., Effects of oral Enterococcus faecium strain DSM 10663 NCIMB 10415 on diarrhoea patterns and performance of sucking piglets. Benef Microbes. Mar. 2015;6(1):41-4. doi: 10.3920/BM2014.0008.
"Campeau, J.L. et al., Intestinal Epithelial Cells Modulate Antigen-Presenting Cell Responses to Bacterial DNA. Infectionand Immunity. Aug. 2012; 80(8): 2632-2644."
Caspi, P.R. Experimental autoimmune uveoretinitis in the rat and mouse. Curr Protoc Immunol. May 2003;Chapter 15:Unit 15.6. doi: 10.1002/0471142735.im1506s53.
Cheluvappa, R. et al., T helper type 17 pathway suppression by appendicitis and appendectomy protects against colitis. Clin Exp Immunol. Feb. 2014;175(2):316-22. doi: 10.1111/cei.12237.
Chen, S. et al., Live combined bacillus subtilis and enterococcus faecium ameliorate murine experimental colitis by immunosuppression. International journal of inflammation. 2014(878054). 7 Pages.
Chi, W. et al., IL-23 promotes CD4+ T cells to produce IL-17 in Vogt-Koyanagi-Harada disease. J Allergy Clin Immunol. May 2007;119(5):1218-24. Epub Mar. 1, 2007.

(56) References Cited

OTHER PUBLICATIONS

Chi, W. et al. Upregulated IL-23 and IL-17 in Behçet patients with active uveitis. Invest Ophthalmol Vis Sci. Jul. 2008;49(7):3058-64. doi: 10.1167/iovs.07-1390.
Collins, M.D., et al., *Enterococcus avium* nom. rev., comb. nov.; *E. casseliflavus* nom. rev., comb. nov.; *E. durans* nom. rev., comb. nov.; *E. gallinarum* comb. nov.; and *E. malodoratus* sp. nov. (1984) Int J Syst Evol Microbiol. 34: 220-223.
Co-pending U.S. Appl. No. 15/592,178, filed May 10, 2017.
Co-pending U.S. Appl. No. 15/631,945, filed Jun. 23, 2017.
Co-pending U.S. Appl. No. 15/631,952, filed Jun. 23, 2017.
Co-pending U.S. Appl. No. 15/679,857, filed Aug. 17, 2017.
Co-pending U.S. Appl. No. 15/700,007, filed Sep. 8, 2017.
Dahya V. et al., Clostridium ramosum Osteomyelitis in an immunocompetent patient after traumatic injury, Infectious Diseases in Clinical Practice 20150312 Lippincott Williams and Wilkins USA, vol. 23, No. 2, Mar. 12, 2015, pp. 102-104, XP009193312, ISSN: 1056-9103 the whole document.
Darlington, G.J., Liver Cell Lines. (1987) Meth Enzymol. 151:19-38.
Day, J.G. et al., Cryopreservation and Freeze-Drying Protocols. Springer. 2007. 2nd edition.
Divyashri et al. Probiotic attributes, antioxidant, anti-inflammatory and neuromodulatory effects of Enterococcus faecium CFR 3003: in vitro and in vivo evidence. (2015) J Med Microbiol. doi: 10.1099/jmm.0.000184.
Duncan et al. (2002) "*Roseburia intestinal* is sp. nov., a novel saccharolytic, butyrate-producing bacterium from human faeces," International Journal System Evolutionary Microbiology. 52:1615-1620.
Duncan et al. (2006) "Proposal of *Roseburia faecis* sp. nov., *Roseburia hominis* sp. nov. and *Roseburia inulinivorans* sp. nov., based on isolates from human faeces," International Journal of Systematic and Evolutionary Microbiology. vol. 56, No. Pt 10, pp. 2437-2441.
Eckburg, PB. et al., Diversity of the human intestinal microbial flora.Science. Jun. 10, 2005;308(5728):1635-8. Epub Apr. 14, 2005.
Fabro, A. et al., The Th17 pathway in the peripheral lung microenvironment interacts with expression of collagen V in the late state of experimental pulmonary fibrosis. (2015) Immunobiology. 220(1):124-35.
Faghih, Z. et a., IL-17 and IL-4 Producing CD8+ T Cells in Tumor Draining Lymph Nodes of Breast Cancer Patients: Positive Association with Tumor Progression. (2013). Iranian Journal of Immunology. 10(4):193-204.
Fahy, J.V. Eosinophilic and neutrophilic inflammation in asthma: insights from clinical studies. Proc Am Thorac Soc. May 1, 2009;6(3):256-9. doi: 10.1513/pats.200808-087RM.
Farooq, P.D. et al., Pseudomembranous colitis, Disease-A-Month 2015 Mosby Inc. USA, vol. 61, No. 5, May 1, 2015, pp. 181-206, XP009193313, ISSN: 0011-5029 p. 195.
FDA Orphan Drug Designations. Total Orphan Drugs website. Aug. 2014. Available at http://www.orphan-drugs.org/2014/09/01/fda-orphandrug-designations-august-2014. Accessed on Apr. 13, 2016.
Frank, D. et al., Molecular-phylogenetic characterization of microbial community imbalances in human inflammatory bowel diseases. 2007. PNAS. 104(34):13780-5.
GB Exam and search report dated Aug. 30, 2016 for GB Application No. 1520638.6.
GB Search and Exam report dated Mar. 31, 2016 for GB application 1510469.8.
GB Search and Exam report dated Mar. 31, 2016 for GB application 1510470.6.
GB Search and Exam report dated Apr. 15, 2016 for GB application 1510467.2.
GB Search and Exam report dated Apr. 20, 2016 for GB application 1510466.4.
GB Search and Exam report dated Apr. 20, 2016 for GB application 1510468.0.
GB Search and Exam report dated Aug. 30, 2016 for GB application no. 1520631.1.
GB Search and Exam report dated Nov. 17, 2016 for GB application 1520502.4.
GB Search and Exam report dated Sep. 13, 2016 for GB application 1520497.7.
Gennaro, A.R., Remington's Pharmaceutical sciences, Mack publishin co. 1985.
Gennaro, A.R., Remington: The Science and practice of pharmacy. 20th edition. 2000.
Ghadimi, D. et al., Epigenetic imprinting by commensal probiotics inhibits the IL-23/1L-17 axis in an in vitro model of the intestinal mucosal immune system. JLB. 2012;92(4):895-911.
Goldin, B.R. et al., Clinical indications for probiotics: an overview. Clin Infect Dis. Feb. 1, 2008;46 Suppl 2:S96-100; discussion S144-51. doi: 10.1086/523333.
Guide for the care and use of laboratory animals: 8th edition. The national academic press; 2011.
Haabeth et al. A model for cancer-suppressive inflammation. (2012) OncoImmunology 1(1):1146-1152.
Hammerich, L. et al., Interleukins in chronic liver disease: lessons learned from experimental mouse models. (2014) Clin Exp Gastroenterol. 7:297-306.
Holdeman, et al., *Eubacterium contortum* (Prevot) comb. nov.: Emendation of description and designation of the type strain. International journal of systematic bacteriology. Oct. 1971;21(4): 304-306.
International Search Report dated Jan. 27, 2017 for International Application No. PCT/GB2016/053622.
International Search Report dated Feb. 17, 2017 for International Application No. PCT/GB2016/053676.
International Search Report dated Aug. 26, 2016 for International application No. PCT/GB2016/051774.
International Search Report dated Aug. 26, 2016 for International application No. PCT/GB2016/051776.
International Search Report dated Sep. 6, 2016 for International application No. PCT/GB2016/051768.
International Search Report dated Sep. 6, 2016 for International application No. PCT/GB2016/051773.
International Search Report dated Sep. 6, 2016 for International application No. PCT/GB2016/051770.
International Search Report dated Feb. 2, 2017 for International application No. PCT/GB2016/053620.
International Search Report dated Mar. 6, 2017 for International Application No. PCT/GB2016/053677.
Ispirli, H. et al., Characterization of functional properties of Enterococcus faecium strains isolated from human gut.Can. J. Microbiol. 61: 861-870 (2015) dx.doi.org/10.1139/cjm-2015-0446.
Jawad, S. et al., Elevated serum levels of interleukin-17A in uveitis patients. Ocul Immunol Inflamm. Dec. 2013;21(6):434-9. doi: 10.3109/09273948.2013.815786. Epub Aug. 19, 2013.
Jiao et al., Blockade of Notch Signaling Ameliorates Murine Collagen-Induced Arthritis via Suppressing Th1 and Th17 Cell Responses. 2014; Pathology, 184(4):1085-1091.
Kailasapathy, K. Microencapsulation of Probiotic Bacteria:Technology and Potential Applications. Curr. Issues Intest. Microbiol. (2002) 3: 39-48.
Kanauchi, et al., Eubacterium limosum ameliorates experimental colitis and metabolite of microbe attenuates colonic inflammatory action with increase of mucosal integrity introduction, China World J Gastroenterol February, Jan. 1, 2006. pp. 1071-1077.
Kang, S. et al., Dysbiosis of fecal microbiota in Crohn's disease patients as revealed by a custom phylogenetic microarray.lnflamm Bowel Dis. Dec. 2010;16(12):2034-42. doi: 10.1002/ibd.21319.
Karaffova, et al., Interaction of TGF-B4 and IL-17 with IgA secretion in the intestine of chickens fed with E. faecium AL41 and challenged with S. Enteritidis. Research in Veterinary science. 2015:75-79.
Karin, M. Nuclear factor-kappaB in cancer development and progression. Nature. May 25, 2006;441(7092):431-6.

(56) References Cited

OTHER PUBLICATIONS

Kitahara, M. et al., *Bacteroides plebeius* sp. nov. and *Bacteroides coprocola* sp. nov., isolated from human faeces. International journal of systematic and evolutionary microbiology. 2005; 55: 2143-2147.
Koenders, M.I. et al., Interleukin-17 Acts Independently of TNF-a under Arthritic Conditions. (2006) J. Immunol. 176:6262-6269.
Kverka, M. et al., Oral administration of Parabacteroides distasonis antigens attenuates experimental murine colitis through modulation of immunity and microbiota composition. Clinical & Experimental Immunology. 2010; 163:250-259.
Laukova, A. et al. Benefits of Combinative Application of Probiotic, Enterocin M-Producing Strain Enterococcus Faecium AL41 and Eleutherococcus Senticosus in Rabbits. Folia Microbiol (Praha) 61 (2), 169-177. Sep. 9, 2015.
Lejeune, FJ. et al., Efficiency of Recombinant Human TNF in Human Cancer Therapy. (2006) Cancer Immun. 6:6.
Leslie, et al., Trehalose and sucrose protect both membranes and proteins in intact bacteria during drying. (1995) Appl. Environ. Microbiol. 61, 3592-3597.
Lodemann, U. et al., Effects of the Probiotic enterococcus faecium and pathogenic *Escherichia coli* strains in a pig and human epithelial intestinal cell model. Hindawi publishing corporation scientifica. 2015(235184) 10 pages.
Luger, D. and Caspi, R.R., New perspectives on effector mechanisms in uveitis. (2008) Semin. Immunopathol. 30(2): 134-143.
Machiels, K. A decrease of the butyrate-producing species *Roseburia hominis* and Faecalibacterium prausnitzii defines dysbiosis in patients with ulcerative colitis.Gut. Aug. 2014;63(8):1275-83. doi: 10.1136/gutjnl-2013-304833. Epub Sep. 10, 2013.
Macpherson, AJ. et al., IgA responses in the intestinal mucosa against pathogenic and non-pathogenic microorganisms. Oct. 2001. 3(12). 1021-1035.
Macpherson, AJ., et al., The functions of mucosal T cells in containing the indigenous commensal flora of the intestine.Cell Mol Life Sci. Dec. 2002;59(12):2088-96.
Manni et al., A tale of two cytokines: IL-17 and IL-22 in asthma and infection. Expert Rev Respir Med. Feb. 2014; 8(1): 25-42. doi:10.1586/17476348.2014.854167.
Mansour et al. Isolation of Enterococcus faecium NM113, Enterococcus faecium NM213 and Lactobacillus casei NM512 as novel probiotics with immunomodulatory properties. (2014) Microbiol Immunol. 58(10):559-69.
Masco, L., et al., Identification of *Bifidobacterium* Species Using rep-PCR Fingerprinting. Systematic and Applied Microbiology 26(4):557-63 Dec. 2003.
Maya, J.R. et al., Emerging Therapies for Noninfectious Uveitis: What May Be Coming to the Clinics. (2014) J. Ophthalmology. 310329.
Mazmanian, SK., An immunomodulatory molecule of symbiotic bacteria directs maturation of the host immune system.Cell. Jul. 15, 2005;122(1):107-18.
Miossec et al., Targeting IL-17 and TH17 cells in chronic inflammation, 2012; Nature Drug Discovery 11, 763-776.
Miossec, P. et al. Targeting IL-17 and TH17 cells in chronic inflammation. Nat Rev Drug Discov. Oct. 2012;11(10):763-76. doi: 10.1038/nrd3794.
Mitropoulou, G. et al. Immobilization Technologies in Probiotic Food Production. (2013) Journal Nutr Metab. (2013) 716861.
Miyake, T. et al., Phylogenetic Analysis of the Genus *Bifidobacterium* and Related Genera Based on 16S rDNA Sequences. Microbiol. Immunol. 1998; 42(10):661-667.
Miyamoto-Shinohara, Y. et al., Survival of freeze-dried bacteria. J Gen Appl Microbiol. Feb. 2008;54(1):9-24.
Monteleone, I. et al., Th17-related cytokines: new players in the control of chronic intestinal inflammation. (2011) BMC Medicine. 2011, 9:122.
Mucientes, A. et al. Specific association of IL17A genetic variants with panuveitis. (2015) Br J Ophthalmol. 99(4):566-70.
Mukai et al., SH3BP2 Gain-Of-Function Mutation Exacerbates Inflammation and Bone Loss in a Murine Collagen-Induced Arthritis Model, 2014 PLoS One 9(8): e105518.
Notice of allowance dated Sep. 1, 2017 for U.S. Appl. No. 15/357,850.
Numasaki, M. et al., IL-17 Enhances the Net Angiogenic Activity and In Vivo Growth of Human Non-Small Cell Lung Cancer in SCID Mice through Promoting CXCR-2-Dependent Angiogenesis. (2005) J. Immunol. 175: 6177-6189.
Numasaki, M. et al., Interleukin-17 promotes angiogenesis and tumor growth. Blood. Apr. 1, 2003;101(7):2620-7. Epub Oct. 31, 2002.
Office Action dated Jan. 11, 2005 for U.S. Appl. No. 10/285,224.
Office Action dated Jan. 26, 2009 for U.S. Appl. No. 10/275,706.
Office Action dated Feb. 18, 2010 for U.S. Appl. No. 10/285,224.
Office Action dated Mar. 13, 2013 for U.S. Appl. No. 12/760,926.
Office Action dated Mar. 26, 2007 for U.S. Appl. No. 10/275,706.
Office Action dated Apr. 4, 2008 for U.S. Appl. No. 10/285,224.
Office Action dated May 2, 2007 for U.S. Appl. No. 10/285,224.
Office Action dated May 2, 2008 for U.S. Appl. No. 10/275,706.
Office Action dated May 25, 2016 for U.S. Appl. No. 14/249,710.
Office Action dated May 26, 2009 for U.S. Appl. No. 10/285,224.
Office Action dated May 26, 2017 for U.S. Appl. No. 15/357,850.
Office Action dated May 30, 2006 for U.S. Appl. No. 10/285,224.
Office Action dated Jun. 26, 2017 for U.S. Appl. No. 15/357,936.
Office Action dated Jul. 6, 2017 for U.S. Appl. No. 15/070,605.
Office action dated Jul. 8, 2015 for U.S. Appl. No. 14/349,907.
Office Action dated Jul. 31, 2017 for U.S. Appl. No. 15/359,988.
Office Action dated Aug. 10, 2017 for U.S. Appl. No. 15/357,850.
Office Action dated Aug. 21, 2013 for U.S. Appl. No. 12/760,926.
Office Action dated Sep. 4, 2015 for U.S. Appl. No. 14/249,710.
Office Action dated Sep. 17, 2010 for U.S. Appl. No. 10/285,224.
Office Action dated Oct. 12, 2005 for U.S. Appl. No. 10/285,224.
Office Action dated Oct. 28, 2009 for U.S. Appl. No. 10/275,706.
Office Action dated Oct. 30, 2008 for U.S. Appl. No. 10/285,224.
Office Action dated Nov. 6, 2006 for U.S. Appl. No. 10/285,224.
Office Action dated Nov. 23, 2015 for U.S. Appl. No. 14/232,475.
Office Action dated Dec. 13, 2012 for U.S. Appl. No. 12/760,926.
Office Action dated Dec. 19, 2005 for U.S. Appl. No. 10/275,706.
Overstreet et al. 'Dysbiosis Characterized by Reduced Abundance of Roseburia is Associated With Increased Severity of Colitis in IL-10-/- Mice'. Gastroenterology. 2011, vol. 140, No. 5, Suppl. 1, pp. S-696.
Pace et al. Macrophage activiation: Priming activity from a T-cell hybridoma is attributable to interferon. (1983) PNAS. 80:3782-6.
Park, S.K. et al., *Blautia stercoris* sp. nov., isolated from human faeces. International journal of systematic and evolutionary microbiology. 2012; 62(4): 776-779.
Patel., R. et al., Determination of 16S rRNA sequences of enterococci and application to species identification of nonmotile enterococcus gallinarum isolates. Journal of clinical microbiology, 1998; 36(11):3399-3407.
Rockwell, S.C. et al., Characteristics of a Serially Transplanted Mouse Mammary Tumor and Its Tissue-Culture-Adapted Derivative. (1972) J Natl Cancer Inst. 49:735-49.
Sakamoto, M. et al., Reclassification of *Bacteroides distasonis, Bacteroides goldsteinii and Bacteroides merdae* as *Parabacteroides distasonis* gen. nov., comb. nov., *Parabacteroides goldsteinii* comb. nov. and *Parabacteroides merdae* comb. nov. International journal of systematic and evolutionary microbiology. 2006; 56: 1599-1605.
Sambrook, J.F. et al., Molecular Cloning: A Laboratory Manual, 3rd ed. Cold spring harbor laboratory press. 2001.
Scanlan PD., et al., Culture-independent analyses of temporal variation of the dominant fecal microbiota and targeted bacterial subgroups in Crohn's disease. J Clin Microbiol. Nov. 2006;44(11):3980-8. Epub Sep. 20, 2006.
Scher et al., Expansion of intestinal Prevotella copri correlates with enhanced susceptibility to arthritis. 2013; eLIFE 2, e01202, 20 Pages.
Schieck, M. et al., Genetic variation in TH17 pathway genes, childhood asthma, and total serum IgE levels.(2014) J Allergy Clin Immunol. 133(3):888-91.
Schleifer, K.H. et al., Transfer of *Streptococcus faecalis* and *Streptococcus faecium* to the Genus *Enterococcus* nom. rev. as *Enterococ-*

(56) References Cited

OTHER PUBLICATIONS cus faecalis comb. nov. and *Enterococcus faecium* comb. nov. Int J Syst Evol Microbiol, Jan. 1984 34: 31-34, doi:10.1099/00207713-34-1-31.

Schmitz, S. et al., A prospective, randomized, blinded, placebo-controlled pilot study on the effect of Enterococcus faecium on clinical activity and intestinal gene expression in canine food—responsive chronic enteropathy. J Vet Intern Med. Mar.-Apr. 2015;29(2):533-43. doi: 10.1111/jvim.12563. Epub Mar. 16, 2015.

Schwiertz, et al., Quantification of Different *Eubacterium* spp. in Human Fecal Samples with Species-Specific 16S rRNA-Targeted Oligonucleotide Probes. Applied and environmental biology, vol. 66, No. 1, Jan. 1, 2000; pp. 375-382.

Severijnen, et al., Chronic Arthritis Induced in Rats by Cell Wall Fragments of *Eubacterium* Species from the Human Intestinal Flora. Infection and Immunity, Feb. 1990; 58(2): p. 523-528.

Sgadari, C. et al., Interferon-inducible protein-10 identified as a mediator of tumor necrosis in vivo. (1996) PNAS. 93:13791-6.

Sgadari et al. Mig, the Monokine Induced by Interferon-g, Promotes Tumor Necrosis In Vivo. (1997) Blood. 89:2635-43.

Shabgah, A.G. et al., Interleukin-17 in human inflammatory diseases. Postepy Dermatol Alergol. Aug. 2014; 31(4): 256-261.

Simpson-Herren, L. et al., Kinetic parameters and growth curves for experimental tumor systems. Cancer Chemother Rep. Jun. 1970;54(3):143-74.

Sisson, G. et al., Randomised clinical trial: a liquid multi-strain probiotic vs. placebo in the irritable bowel syndrome—a 12 week double-blind study. Aliment Pharmacol Ther. 2014; 40: 51-62.

Sivieri, K. et al., Probiotic enterococcus faecium CRL 183 inhibit chemically induced colon cancer in male wistar rats. Eur Food Res Technol. 2008; 228:231-237.

Smith, T.F. et al., Comparison of biosequences. (1981) Adv. Appl. Math. 2: 482-489.

Song et al., Impact of Schistosoma japonicum Infection on Collagen-Induced Arthritis in DBA/1 Mice: A Murine Model of Human Rheumatoid Arthritis. 2011; PLoS One 6, e23453, 10 pages.

Spor, A. et al., Unravelling the effects of the environment and host genotype on the gut microbiome. Nat Rev Microbiol. Apr. 2011;9(4):279-90. doi: 10.1038/nrmicro2540.

Srutkova, D. et al., Efficiency of PCR-based methods in discriminating *Bifidobacterium longum* ssp. *longum* and *Bifidobacterium longum* ssp. *infantis* strains of human origin.J Microbiol Methods. Oct. 2011;87(1):10-6. doi: 10.1016/j.mimet.2011.06.014. Epub Jul. 2, 2011.

Stoll et al., Altered microbiota associated with abnormal humoral immune responses to commensal organisms in enthesitis-related arthritis, 2014; Arthritis Res Ther. 16:486.

Strickertsson, J.A. et al., Enterococcus faecalis Infection and Reactive Oxygen Species Down-Regulates the miR-17-92 Cluster in Gastric Adenocarcinoma Cell Culture. Genes 2014, 5(3), 726-738.

Strobel, H.J. Basic laboratory culture methods for anaerobic bacteria. Methods Mol Biol. 2009;581:247-61. doi: 10.1007/978-1-60761-214-8_16.

Sun, D. et al., the role of Th17-associated cytokines in the pathogenesis of experimental autoimmune uveitis (EAU). (2015) Cytokine. 74(1):76-80.

Tesmer, L.A. et al., Th17 cells in human disease. Immunol Rev. 2008;223:87-113.

Toomer, O. et al., Maternal and postnatal dietary probiotic supplementation enhances splenic regulatory T helper cell population and reduces peanut allergen-induced hypersensitivity responses in mice. Immunobiology. 209; 2014: 661-670.

Tsukinowa, et al., Fecal microbiota of a dugong (Dugong dugong) in captivity at Toba Aquarium. J. Gen. Appl. Microbiol., 54, 25-38 (2008).

Udayappan, et al., Oral treatment with Eubacterium hallii improves insulin sensitivity in db/db mice. NPJ Biofilms and microbiomes, vol. 2, Jul. 6, 2016; p. 16009.

Udayappan et al., PS4-5. Administration of Eubacterium hallii improves insulin sensitivity and degree of liversteatosis in male db/db mice. Nederlands tijdschrift voor diabetologie, vol. 11, No. 4., Nov. 23, 2013.pp. 145.

Vetrovsky, T. and Baldrian, P., The variability of the 16S rRNA gene in bacterial genomes and its consequences for bacterial community analyses. Plos One. Feb. 2013; 8(2): e57923.

Workman et al. Guidelines for the welfare and use of animals in cancer research (2010) Br. J. Cancer. 102:1555-77.

Wunderlich, P.F. et al., Double-blind report on the efficacy of lactic acid-producing enterococcus SF68 in the prevention of antibiotic-associated diarrhoea and in the treatment of acute diarrhoea. The journal of international medical research. 1989; 17: 333-338.

Yang, J. et al., Targeting Th17 cells in autoimmune diseases. Trends Pharmacol Sci. Oct. 2014;35(10):493-500. doi: 10.1016/j.tips.2014.07.006. Epub Aug. 14, 2014.

Ye, X. et al., The Role of IL-23/Th17 Pathway in Patients with Primary Immune Thrombocytopenia. (2015) PLoS One. 10(1):e0117704.

Yin, X. et al., Combined effect of five single nucleotide polymorphisms related to IL23/Th17 pathway in the risk of psoriasis. Immunogenetics. Mar. 2014;66(3):215-8. doi: 10.1007/500251-013-0756-z. Epub Jan. 14, 2014.

Zhang, B. et al., Oral administration of enterococcus faecalis FK-23 suppresses Th17 cell development and attenuates allergic airway responses in mice. International journal of molecular medicine. 2012; 30:248-254.

Zhang, B. et al., The Prevalence of Th17 Cells in Patients With Gastric Cancer. 2008. Biochem Biophys Res Commun 374 (3), 533-537.

Zhang, et al., The Activation of NF-κB in Infiltrated Mononuclear Cells Negatively Correlates with Treg Cell Frequency in Oral Lichen Planus. Inflammation. Aug. 2015;38(4):1683-9. doi: 10.1007/s10753-015-0145-x.

Zheng, B. et al., Bifidobacteriu breve attenuates murine dextran sodium sulfate-induced colitis and increases regulatory T cell responses. PLOS one. May 2014; 9(5).

Zhongyuan, T. et al., The inflammation regulation effects of enterococcus faecium HDRsEf1 on human enterocyte-like HT-29 cells. Animal cells and systems. Mar. 2016;20(2):70-76.

Zitomersky, N. et al., Characterization of Adherent Bacteroidales from Intestinal Biopsies of Children and Young Adults with Inflammatory Bowel Disease. PLOS one. 2013; 8(6).

Zitvogel, et al., Type I interferons in anticancer immunity. Nature Reviews. Jul. 2015:405-414.

4d Pharma Plc: "Clinical Update—RNS—London Stock Exchange", Jul. 19, 2016.

Anonymous: "4D pharma's Blautix for Irritable Bowel Syndrome shows positive impact—pharmaceutical daily news", Dec. 13, 2016.

Atarashi, et al., Treg induction by a rationally selected mixture of Clostridia strains from the human microbiota. Supplementary Information. Nature 500, 232-236 (Aug. 8, 2013) doi:10.1038/nature12331.

ATCC Catalog, https://www.atcc.org/search_results.aspx?dsNav=Ntk:primarysearch%7cbacteroides+thetaiotaomicron%7c3c%7c,Ny:true,ro:0,N:1000552searchterms=bacteroides+thetaiotaomicron&redir=1, Accessed on May 2, 2018.

Banfield, J. & Murphy, K.R., Non-Th2, Late-onset, non-allergic asthma. Copd & Asthma for NPs, A peer-reviewed newsletter, Aug. 2016; 14: 8 Pages.

Barry, et al., Criteria for Disksusceptibility tests and quality control guidelines for the cefoperazone-sulbactam combination, Journal of clinical microbiology, Jan. 1988;26(1):13-17.

Berger, S. Gideon guide to medically important bacteria. Gideon E-book Series. 2017 edition. 4 pages.

Bernalier et al. *Ruminococcus hydrogenotrophicus* sp. nov., a new H2/CO2-utilizing acetogenic bacterium isolated from human feces. 1996 Arch. Microbiol. 166 (3), 176-183.

Brook, I., Clinical Review: Bacteremia caused by anaerobic bacteria in children. Critical Care 6(3): 7 pages (2002).

Cekanaviciute, et al., Gut bacteria from multiple sclerosis patients modulate human T cells and exacerbate symptoms in mouse models. PNAS. Jun. 30, 2017; 1-6.

(56) References Cited

OTHER PUBLICATIONS

Charriot, et al., Future treatment for ashtma, Eur Respir Rev 2016; 25: 77-92.
Colowick, S. and Kaplan, N., Methods of Enzymology. Academic Press, Inc. 1996.
Co-pending U.S. Appl. No. 15/906,988, filed Feb. 27, 2018.
Co-pending U.S. Appl. No. 15/915,885, filed Mar. 8, 2018.
Co-pending U.S. Appl. No. 15/915,889, filed Mar. 8, 2018.
Co-pending U.S. Appl. No. 15/916,167, filed Mar. 8, 2018.
Co-pending U.S. Appl. No. 15/916,202, filed Mar. 8, 2018.
Co-pending U.S. Appl. No. 15/916,205, filed Mar. 8, 2018.
Co-pending U.S. Appl. No. 15/969,543, filed May 2, 2018.
Demarche, et al., Detailed analysis of sputum and systemic inflammation in asthma phenotypes: are paucigranulocytic asthmatics really non-inflammatory?, BMC Pulmonary Medicine, 2016; (16)46: 1-13.
Distrutti, et al., Gut Microbiota role in irritable bowel syndrome: New therapeutic strategies. World Journal of Gastroenterology. Feb. 21, 2016; 22(7): p. 2219-2241, XP002769875.
Falony, et al., Coculture Fermentations of *Bifidobacterium* species and bacteroides thetaiotaomicron Reveal a mechanistic insight into the prebiotic effect of inulin-type Fructans. Applied and environmental microbiology, Apr. 2009;75(8):2312-2319.
Frick, et al., Identification of commensal bacterial strains that modulate Yersinia enterocolitica and Dextran sodium sulfate-induced inflammatory responses: implications for the development of probiotics. Infection and immunity, Jul. 2007;75(7):3490-3497.
International search report with written opinion dated Feb. 26, 2018 for PCT/GB2017/053722.
Ishikawa, et al., Effect of bifidobacteria to suppress Th17, Food Science and technology institute, 2008, 5 Pages.
Kelly, et al., Commensal gut bacteria: mechanisms of immune modulation. TRENDS in immunology, 2005;26(6):326-333.
Kirsty Minton: Mucosal immunology: The ins and outs of gut inflammation, The journal of immunology, 4(2), Feb. 1, 2004: pp. 81-81, XP055252701.
Kogyo, S. Lactic Acid Bacteria, Intestinal Flora ad Health II; Physiological effects of heat-treated lactococcus "EF-2001" and application to food. Mar. 30, 2001, vol. 44, No. 6, pp. 35-39.
Lee, et al. Intestinal microbiota in pathophysiology and management of irritable bowel syndrome . 2014. World J Gastroenterol. 20(27): 8886-8897.
Liu et al. Reclassification of *Clostridium coccoides, Ruminococcus hansenii, Ruminococcus hydrogenotrophicus, Ruminococcus luti, Ruminococcus productus* and *Ruminococcus schinkii* as *Blautia coccoides* gen. nov., comb. nov., *Blautia hansenii* comb. nov., *Blautia hydrogenotrophica* comb. nov., *Blautia luti* comb. nov., *Blautia producta* comb. nov., *Blautia schinkii* comb. nov. and description of *Blautia wexlerae* sp. nov., isolated from human faeces. 2008. Int J Syst Evol Microbiol 58,1896-1902.
Lopetuso et al. Commensal Clostridia: leading players in the maintenance of gut homeostasis. 2013. Gut Pathogens, 5: 23.
Narushima, et al., Characterization of the 17 strains of regulatory T cell-inducing human-derived Clostridia. Gut Microbes Mar. 18, 2014; 5:3, 333-339.
Nuala Moran: 'Microbial wealth', chemistry and industry, 78(6), Jun. 1, 2014, pp. 20-23, XP055252922.
Office Action dated Jan. 2, 2018 for U.S. Appl. No. 15/357,936.
Oladipo, et al., Bioprotective potential of bacteriocinogenic enterococcus gallinarum strains isolated from some Nigerian fermented foods, and of their bacteriocins. Polish Journal of Microbiology. 2014; 63(4): 415-422.
PCT/EP2017/025038 Written Opinion of the International Preliminary Examining Authority dated Jan. 1, 2018.
Pearson, WR. An introduction to sequence similarity ("Homology") searching. Current protocols in bioinformatics/editoral board, Andreas D Baxevanis. [et al]. 2013; 0 3:10. 1002/0471250953. bi0301s42. doi:10.1002/0471250953.bi0301s42.
Robinson, et al. Inside information—The unique features of visceral sensation. 2008. Mol Interv, 8(5): 242-253.
Salix Pharmaceuticals, Inc. FDA Highlights of Prescribing Information—Xifaxan (rifaximin tablet). Revised Nov. 2015.
U.S. Appl. No. 15/915,889 Notice of Allowance dated Jun. 4, 2018.
U.S. Appl. No. 15/700,007 Office Action dated Jun. 1, 2018.
Stanton et al. (1983) "*Roseburia cecicola* gen. nov., sp. nov., a Motile, Obligately Anaerobic Bacterium from a Mouse Cecum," Int. J. Syst. Bacterial. 33:618-627.
Tamanai-Shacoori, et al., *Roseburia* spp.: a marker of health?. Future Microbiology Review 12(2), 157-170 (2017).
Tap et al. Towards the human intestinal microbiota phylogenetic core. 2009. Environ Microbiol, 11(10):2574-84.
U.S. Appl. No. 15/357,936 Notice of Allowance dated Apr. 18, 2018.
U.S. Appl. No. 15/359,988 Notice of Allowance dated Mar. 2, 2018.
U.S. Appl. No. 15/359,988 Notice of Allowance dated Mar. 16, 2018.
U.S. Appl. No. 15/592,178 Notice of Allowance dated Apr. 12, 2018.
U.S. Appl. No. 15/916,202 Notice of Allowance dated Jun. 11, 2018.
U.S. Appl. No. 15/359,144 Office Action dated Apr. 10, 2018.
U.S. Appl. No. 15/359,972 Office Action dated Apr. 4, 2018.
U.S. Appl. No. 15/631,945 Office Action dated Jul. 5, 2018.
U.S. Appl. No. 15/631,945 Office Action dated May 15, 2018.
U.S. Appl. No. 15/631,952 Office Action dated Feb. 16, 2018.
U.S. Appl. No. 15/679,857 Office Action dated Feb. 14, 2018.
U.S. Appl. No. 15/803,723 Notice of Allowance dated Feb. 13, 2018.
Van De Bogert, et al., Immunomodulatory properties of *Streptococcus* and veillonella isolates from the human small intestine microbiota, PLOS One, Dec. 2014: 1-20, D01:10.1371/journal.pone. 0114277.
Wrzosek, et al., Bacteroides thetaiotaomicron and Faecalibacterium prausnitzii influence the production of mucus glycans and the development of globlet cells in the colonic epithelium of a gnotobiotic model rodent. BMC biology, 2013;11(61):1-13.
Xu, et al., The endogenous hydrogen sulfide producing enzyme cystathionine-i synthase contributes to visceral hypersensitivity in a rat model of irritable bowel syndrome. Molecular Pain, Biomed central, London, GB. Aug. 6, 2009; 5(1):p. 44.
Xu, J. et al., "Message from a human gut symbiont: sensitivity is a prerequisite for sharing", Trends in microbiology, 12(1), Jan. 1, 2004: pp. 21-28, XP055253932.
Yu, et al., Utilization of major fucosylated and sialylated human milk oligosaccharides by isolated human gut microbes. Glycobiology, 2013; 23(11):1281-1292.
Zhou et al. Central and peripheral hypersensitivity in the irritable bowel syndrome. 2010. Pain. 148(3): 454-461.
Buffie et al., Precision microbiome restoration of bile acid-mediated resistance to Clostridium difficile. Nature, 517(7533):205-208 (2015).
Christmann, et al., Human seroreactivity to gut microbiota antigens. J Allergy Clin Immunol 136(5):1378-1386; available online May 23, 2015.
Colin, et al., GIC-1001, a Clinical Stage, Orally Administered Colonic Analgesic Drug Proposed As a Cost-Effective Alternative to I.V. Sedation Used in Colonoscopy. Canadian Digestive Diseases Week, 2014; 2 pages.
Co-pending U.S. Appl. No. 16/022,207, filed Jun. 28, 2018.
Co-pending U.S. Appl. No. 16/022,256, filed Jun. 28, 2018.
Co-pending U.S. Appl. No. 16/022,484, filed Jun. 28, 2018.
Co-pending U.S. Appl. No. 16/022,577, filed Jun. 28, 2018.
Co-pending U.S. Appl. No. 16/031,024, filed Jul. 10, 2018.
Co-pending U.S. Appl. No. 16/040,356, filed Jul. 19, 2018.
Co-pending U.S. Appl. No. 16/100,349, filed Aug. 10, 2018.
Co-pending U.S. Appl. No. 16/147,551, filed Sep. 28, 2018.
Distrutti, et al., 5-Amino-2-hydroxybenzoic Acid 4-(5-Thioxo-5H[1,2]dithiol-3yl)-phenyl Ester (ATB-429), a Hydrogen Sulfide-Releasing Derivative of Mesalamine, Exerts Antinociceptive Effects in a Model of Postinflammatory Hypersensitivity. The Journal of pharmacology and experimental therapeutics, 2006;319(1):447-458.
Farmer, et al., Gut pain & visceral hypersensitivity. British journal of pain, 2013;7(1):39-47.

(56) References Cited

OTHER PUBLICATIONS

GB1809729.5 Examination Report dated Oct. 15, 2018.
GenBank Accession No. NR_044054.1 (Feb. 3, 2015) Blautia wexlerae strain SSM 19850 16S ribsomal RNA gene, partial sequence.
GenBank Accession No. NR_117867.1 (Feb. 3, 2015) Blautia stercoris strain GAM6-1 16S ribsomal RNA gene, partial sequence.
Lozupone. Diversity, stability and resilience of the human gut microbiota. 2012. Nature. Sep. 13, 2012; 489 (7415): 220-230.
Sun, et al., Exploring gut microbes in human health and disease: Pushing the envelope. Genes Dis. Dec. 2014; 1(2):132-139.doi:10.1016/j.gendis.2014.08.001.
U.S. Appl. No. 15/592,178 Notice of Allowance dated Jul. 12, 2018.
U.S. Appl. No. 15/631,945 Notice of Allowance dated Oct. 18, 2018.
U.S. Appl. No. 15/700,007 Notice of Allowance dated Oct. 17, 2018.
U.S. Appl. No. 15/631,952 Office Action dated Jul. 19, 2018.
U.S. Appl. No. 15/679,857 Office Action dated Aug. 6, 2018.
U.S. Appl. No. 15/704,245 Office Action dated Sep. 17, 2018.
U.S. Appl. No. 15/842,635 Office Action dated Aug. 27, 2018.
Van Tilburg, M. Can we treat visceral hypersensitivity in functional abdominal pain? Lancet Gastroenterolhepatol, 2017; 2 Pages.
Jan. 17, 2019 First Office Action for CN201680041407.6 (Translated).
4D Pharma:"4Dpharma PLC clinical update on blautix (TM), a novel treatment to irritable bowel syndrome," 4DPharma, Jan. 19, 2016, XP002769874, Retrieved from: https://www.directorstalkinterviews.com/4d-pharma-plc-clinical-update-on-blautix-a-novel-treatment-for-irritable-bowel-syndrome/412689588. [Retrieved on May 5, 2017].
Ahanchian, Hamic, A multi-strain synbiotic may reduce viral respiratory infections in asthmatic children: a randomized controlled trial; Sep. 2016, vol. 8, Issue 9, PP2833-2839, DOI: http://dxdoi.or/10.19082/2833.
Alp, G., and Aslim, B. (2010). Relationship between the resistance to bile salts and low pH with exopolysaccharide (EPS) production of Bifidobacterium spp. isolated from infants feces and breast milk. Anaerobe 16(2), 101-105. doi: 10.1016/j.anaerobe.2009.06.006.
Altschul et al. 'Basic local alignment search tool.' Journal of Molecular Biology. 1990, vol. 215, No. 3, pp. 403-410.
Aminov et al. Molecular diversity, cultivation, and improved detection by fluorescent in situ hybridization of a dominant group of human gut bacteria related to Roseburia spp. or Eubacterium rectale. Applied and environmental microbiology. 2006, vol. 72, No. 9, pp. 6371-6376.
An et al. (1985) "New cloning vehicles for transformation of higher plants," EMBO J. 4:277-284.
An et al. (1988) "Binary Vectors," Plant Molecular Biology Manual. A3:1-19.
An et al. Transformation of Tobacco, Tomato, Potato, and Arabiodopsis thaliana Using a Binary Ti Vector System, Plant Physiol. May 1986; 81:301-305.
Appleyard, Caroline B. et al., Pretreatment with the probiotic VSL#3 delays transition from inflammation to dysplasia in rate model of colitis-associated cancer; Am J. Physiol. Gastrointest. Liver Physiol. 301:G1004-G1013, 2011 Sep. 8, 2011:DOI:10.1152.ajpg.00167.2011.
Archer et al. (1997) "The Molecular Biology of Secreted Enzyme Production by Fungi," Critical Reviews Biotechnology. 17(4):273-306.
Atarashi et al. Induction of colonic regulatory T cells by indigenous Clostridium species. Science 331(6015):337-341 (2011).
Ausubel et al. (1999) Short Protocols in Molecular Biology. 4th edition. pp. 7-58 to 7-60, and Chapter 18. pp. 18-1 to 18-23.
Awadel-Kariem, Mustafa et al., First report of Parabacteroides goldsteinii bacteraemia in a patient with complicated intra-abdominal infection, Anaerobe, vol. 16, Issue 3, Jun. 2010, pp. 223-225.
Aziz et al. The RAST Server: rapid annotations using subsystems technology.' BMC Genomics. 2008, vol. 9, No. 1, pp. 75.

Aziz, R.K., Bartels, D., Best, A.A., DeJongh, M., Disz, T., Edwards, R.A., et al. (2008). The RAST Server: Rapid Annotations using Subsystems Technology. BMC Genomics 9, 75. doi: 10.1186/1471-2164-9-75.
Barcenilla et al. "Phylogenetic relationships of butyrate-producing bacteria from the human gut" Applied and environmental microbiology. 2000, vol. 66, No. 4, pp. 1654-1661.
Beaucage, et al. Deoxynucleoside phosphoramidites—A new class of key intermediates for deoxypolynucleotide synthesis. Tetrahedron Letters, vol. 22, 1981, pp. 1859-1869.
BEGGS (1978) "Transformation of yeast by a replicating hybrid plasmid," Nature. 275:104-109.
Begley, M., Hill, C., and Gahan, C.G.M. (2006). Bile Salt Hydrolase Activity in Probiotics. Applied and Environmental Microbiology 72(3), 1729-1738. doi: 10.1128/AEM.72.3.1729-1738.2006.
Berg et al. (1996) "Enterocolitis and colon cancer in interleukin-10-deficient mice are associated with aberrant cytokine production and CD4(+) TH1-like responses," The Journal of Clinical Investigation. 98(4):1010-1020.
Berger, B., Moine, D., Mansourian, R., and Arigoni, F. (2010). HspR Mutations Are Naturally Selected in Bifidobacterium longum When Successive Heat Shock Treatments Are Applied. Journal of Bacteriology 192(1), 256-263. doi: 10.1128/jb.01147-09.
Bergonzelli, G.E., Granato, D., Pridmore, R.D., Marvin-Guy, L.F., Donnicola, D., and Corthesy-Theulaz, I.E. (2006). GroEL of Lactobacillus johnsonii La1 (NCC 533) is cell surface associated: potential role in interactions with the host and the gastric pathogen Helicobacter pylori. Infect Immun 74(1), 425-434. doi: 10.1128/IAI.74.1.425-434.2006.
Bernalier, A., et al., "Diversity of H2/C02-utilizing acetogenic Bacteria from Feces of Non-Methane-Producing Humans", Current Microbiology vol. 33 (Aug. 1996), pp. 94-99, Springer-Vertag New York Inc., USA.
Bernalier et al., "Acetogenesis from H02 and C0-2 By Methane and Non-Methane-Producing Human Colonic Bacterial Communities" Fems Microbiology Ecology. vol. 19. No. 3. 1996. pp. 193-202. XP000979130.
Blandino, G., Fazio, D., DiMarco, R. Probiotics: Overview of microbiological and immunological characteristics (2008). Expert Review of Anti-Infective Therapy, 6 (4), pp. 497-508.
Bond, John H., Jr., et al., "Factors Influencing Pulmonary Medicine Excretion in Man: An indirect method of studying the in situ metabolism of the methane-producing colonic bacteria"; Journal of Experimental Medicine, Oct. 29, 1970, pp. 572-388.
Born, P., et al., English Abstract "Carbohydrate substitutes: comparative study of intestinal absorption of fructose, sorbitol and xylitol", "Zuckeraustauschstoffe: Vergleichende Untersuchung zur intestinalen Resorption von Fructose, Sorbit and Xylit", Medizinische Klinik 89, Technischen Universitat Munchen (Munich) Nov. 15, 1994; 89 (11): 575-8 (Article in German), Urban & Vogel, Munich, Germany.
Born, P., et al., "Fecal bacterial activity in symptomatic carbohydrate malabsorption: Effect on the fecal short-chain fatty acid ratio", intervention during the week "Digestive Diseases Week" from May 16 to May 19, 1999, Orlando, Z. Gasteroenterol2000: 38:623-626, Georg Thieme Verlag Stuttgart, New York, USA.
Bottacini, F., Morrissey, R., Esteban-Torres, M., James, K., van Breen, J., Dikareva, E., et al. (2018). Comparative genomics and genotype-phenotype associations in Bifidobacterium breve. Scientific Reports 8(1), 10633. doi: 10.1038/s41598-018-28919-4.
Bottacini, F., O'Connell Motherway, M., Kuczynski, J., O'Connell, K.J., Serafini, F., Duranti, S., et al. (2014). Comparative genomics of the Bifidobacterium breve taxon. BMC Genomics 15(1), 170. doi: 10.1186/1471-2164-15-170.
Brasel et al. (2000) "Generation of murine dendritic cells from ftl3-ligand-supplemented bone marrow cultures," Blood. 96(9):3029-3039.
Bressa, et al., Differences in gut microbiota profile between women with active lifestyle and sedentary women. Plos One, 2017; 12(2): 1-20.
Bry et al. A model of host-microbial interactions in an open mammalian ecosystem. Science 273(5280):1380-1383 (1996).

(56) References Cited

OTHER PUBLICATIONS

Butcher et al. (1980) The role of tissue culture in the study of crown-gall tumorigenesis. Tissue Culture Methods for Plant Pathologists. Eds.: Ingrams, D. S.; Helgeson, J.P. pp. 203-208.
Candela et al. 'Interaction of probiotic Lactobacillus and Bifidobacterium strains with human intestinal epithelial cells:Adhesion properties, competition against enteropathogens and modulation of IL-8 production'. International Journal of Food Microbiology. 2008, vol. 125, No. 3, pp. 286-292.
Candela, M., Bergmann, S., Vici, M., Vitali, B., Turroni, S., Eikmanns, B.J., et al. (2007). Binding of human plasminogen to Bifidobacterium. J Bacteriol 189(16), 5929-5936. doi: 10.1128/Jb.00159-07.
Candela, M., Biagi, E., Centanni, M., Turroni, S., Vici, M., Musiani, F., et al. (2009). Bifidobacterial enolase, a cell surface receptor for human plasminogen involved in the interaction with the host. Microbiology 155(Pt 10), 3294-3303. doi: 10.1099/mic.0.028795-0.
Candela, M., Centanni M Fau—Fiori, J., Fiori J Fau—Biagi, E., Biagi E Fau—Turroni, S., Turroni S Fau—Orrico, C., Orrico C Fau—Bergmann, S., et al. (2010). DnaK from *Bifidobacterium animalis* subsp. lactis is a surface-exposed human plasminogen receptor upregulated in response to bile salts. Microbiology 156(6), 1609-1618.
Caruthers, et al. New chemical methods for synthesizing polynucleotides. Nucleic Acids Symp Ser. 1980;(7):215-23.
Carvalho et al. (Jan. 2011) "TLR5 activation induces secretory interleukin-1 receptor antagonist (sll-1 Ra) and reduces inflammasome-associated tissue damage," Nature. 4(1):1 02-111.
Casey et al. 'Isolation and characterization of anti-*Salmonella* lactic acid bacteria from the porcine gastrointestinal tract'. Letters in Applied Microbiology. 2004, vol. 39, No. 5, pp. 431-438.
Cereghino et al. (2000) "Heterologous protein expression in the methylotrophic yeast Pichia pastoris," FEMS Microbiol Review. 24(1):45-66.
Chevreux et al. 'Genome sequence assembly using trace signals and additional sequence information.' German Conference on Bioinformatics. 1999.
Chothia et al. The relation between the divergence of sequence and structure in proteins. EMBO Journal. 1986, 5(4):823-826.
Christiaen, S.E., O'Connell Motherway, M., Bottacini, F., Lanigan, N., Casey, P.G., Huys, G., et al. (2014). Autoinducer-2 plays a crucial role in gut colonization and probiotic functionality of Bifidobacterium breve UCC2003. PLoS One 9(5), e98111. doi: 10.1371/journal.pone.0098111.
Christou (1994) "Genetic engineering of crop legumes and cereals: current status and recent advances," Agro-Food Industry Hi-Tech. pp. 17-27.
Chung et al. 'Microbiota-stimulated immune mechanisms to maintain gut homeostasis.' Current Opinion in Immunology. 2010, vol. 22, No. 4, pp. 455-460.
Cintas LM, Casaus MP, Herranz C, Nes IF, Hernandez PE. Review: bacteriocins of lactic acid bacteria (2001). Food Sci Technol 7(4):281-305.
Claesson, et al. Gut microbiota composition correlates with diet and health in the elderly. 2012. Nature, 488, 178-184.
Claims to be granted in European Application No. 15817513.3.
Clarridge III, J.E. Impact of 16S rRNA gene sequence analysis for identification of bacteria on clinical microbiology and infectious diseases (2004). Clinical Microbiology Reviews, 17 (4), pp. 840-862.
Clinical Trials for Thetanix, EU Clinical Trials Register, Date of commencement of clinical trial: Oct. 16, 2015. Available at: https://clinicaltrialsregister.eu/ctr-search/search?query=Thetanix.
CN Office Action dated Jan. 17, 2019, for CN 201680041407.6 (translation not yet available).
Constantinescu et al. Experimental autoimmune encephalomyelitis (EAE) as a model for multiple sclerosis (MS). 2011. Br J Pharmacol. 164(4):1079-1106.
Cotter, P.O., Hill, C., Ross, R.P. Food microbiology: Bacteriocins: Developing im1ate immunity for food (2005). Nature Reviews Microbiology, 3 (10), pp. 777-788.
Crellin et al. (2005) "Human CD4+ T cells express TLRS and its ligand ftagellin enhances the suppressive capacity and expression of FOXP3 in CD4+CD25+ T regulatory cells," Journal of Immunology. 175(12):8051-8059.
Cronin, M., Knobel, M., O'Connell-Motherway, M., Fitzgerald, G.F., and van Sinderen, D. (2007). Molecular Dissection of a Bifidobacterial Replicon. Applied and Environmental Microbiology 73(24), 7858-7866.
Cummings, M., Breitling, R., and Takano, E. (2014). Steps towards the synthetic biology of polyketide biosynthesis. Fems Microbiology Letters 351(2), 116-125. doi: 10.1111/1574-6968.12365.
Darfeuille-Michaud et al. High prevalence of adherent-invasive *Escherichia coli* associated with ileal mucosa in Crohn's disease. .2004. Gastroenterology 127(2):412-21.
Database UniProt [Online] Jun. 1, 2003 (Jun. 1, 2003), "subname:Full= possible pirin family protein {ECO:0000313|EMBL AAO75294.1};", XP00275366, retrieved from EBI accession No. UNIPROT:Q8ABC3 Database accession No. Q8ABC3.
Davis et al. (1971) "Genetic and Microbiological Research Technqiues," Methods Enzymol. 17A:79-143.
De Paepe et al. 'Trade-off between bile resistance and nutritional competence drives *Escherichia coli* diversification in the mouse gut.' PLoS Genetics. 2011, vol. 7, No. 6, e1002107.
de Ruyter, P.G., Kuipers, O.P., and de Vos, W.M. (1996). Controlled gene expression systems for *Lactococcus lactis* with the food-grade inducer nisin. Applied and Environmental Microbiology 62(10), 3662-3667.
Deangelis, M., et al., Selection of potential probiotic lactobacilli from pig feces to be used as additives in pelleted feeding (2006). Research in Microbiology, 157 (8), pp. 792-801.
Delgado, S., Ruiz, L., Hevia, A., Ruas-Madiedo, P., Margolles, A., and Sánchez, B. (2018). "Evidence of the In Vitro and In Vivo Immunological Relevance of Bifidobacteria," in The Bifidobacteria and Related Organisms.), 295-305.
Dennis et al. 'DAVID: database for annotation, visualization, and integrated discovery.' Genome Bioi. 2003, vol. 4, No. 5, pp. 3.
Distrutti, et al., Hydrogen sulphide induces u opioid receptor-dependent analgesia in a rodent model of visceral pain. Molecular Pain, 2010; 6(36):1-16.
DMSZ: Opening of Ampoules and Rehydration of Dried Cultures; (http://web.archive.org/web/20000 52411541 O/www.dsmz.de/open. htm); updated of website on Mar. 2000.
Dong, H., Rowland I Fau—Yacioob, P., and Yacioob, P. (2012). Comparative effects of six probiotic strains on immune function in vitro. Br J Nutr 108(3), 459-470. doi: 10.1017/S0007114511005824.
Drago, Lorenzo et al., Immunodulatory Effects of Lactobucillus salivarius LS01 and *Bifidobacterium breve*, Alone and in Combination on Peripheral Blood Mononuclear Cells of Allergic Asthmatics; Allergy Asthma Immunol. Res. Jul. 2015: 7(4):409-413.
Duck et al. 'Isolation of flagellated bacteria implicated in Crohn's disease.' Inflammatory Bowel Diseases. 2007, vol. 13, No. 10, pp. 1191-1201.
Duncan et al. "Lactate-utilizing bacteria, isolated from human feces, that produce butyrate as a major fermentation product" Applied and environmental microbiology. 2004, vol. 70, No. 10, pp. 5810-5817.
Duncan, et al. *Roseburia intestinalis* sp. nov., a novel saccharolytic, butyrate-producing bacterium from human faeces. Int J Syst Evol Microbiol. Sep. 2002;52(Pt 5):1615-20.
Durand et al., "Reductive Acetogenesis in Animal and Human Gut." Physiological and Clinical Aspects of Short-Chain Fatty Acids, 1995. pp. 107-117, XP000979817 Cambridge University Press ISBN 0-521-44048-3.
Elhenawy et al., Preferential packing of acidic glycosidases and proteases into bacteroides Outer membrane vesicles. mBio 5:e00909-14, pp. 1-12, 2014.
Elkins et al. 'Genes encoding bile salt hydrolases and conjugated bile salt transporters in *Lactobacillus johnsonii* 100-100 and other *Lactobacillus* species.' Microbiology. 2001, vol. 147, No. 12, pp. 3403-3412.
Elmadfa, 1., Klein, P., Meyer, AL. Immune-stimulating effects oflactic acid bacteria in vivo and in vitro (2010). Proceedings of the Nutrition Society, 69 (3), pp. 416-420.

(56) References Cited

OTHER PUBLICATIONS

Ely et al. (2000) "A family of six flagellin genes contributes to the Caulobacter crescentus flagellar filament," Journal of Bacteriology. 182(17):5001-5004.
Embl sequence AAO75294.1 (2003)—provided within the Office Action dated Feb. 16, 2018 in U.S. Appl. No. 15/631,952. 2 Pages.
Eren, A. Murat et al., "A single genus in the gut microbiome reflects host preference and specificity," The ISME Journal (2015) 9, 9-100 (2015).
ESR Dated Dec. 17, 2018, Appl. 18189521.0.
European Communication dated Jun. 14, 2017 for EP Application No. 15817513.3.
Evelo Biosciences, Inc. Clinical Trials (Rank 1): A Study of EDP1503 in Patients With Colorectal Cancer, Breast Cancer, and Checkpoint Inhibitor Relapsed Tumors, https://clinicaltrials.gov/ct2/show/NCT03775850?spons=evelo&rank=1.
Evelo Biosciences, Inc. Clinical Trials (Rank 2): A Study of EDP1815 in Healthy Participants and Participants With Mild to Moderate Psoriasis and Atopic Dermatitis, https://clinicaltrials.gov/ct2/show/NCT03733353?spons=evelo&rank=2.
Evelo Biosciences, Inc. Clinical Trials (Rank 3): A Study of EDP1066 in Healthy Participants and Participants With Mild to Moderate Psoriasis and Atopic Dermatitis, https://clinicaltrials.gov/ct2/show/NCT03542994?spons=evelo&rank=3.
Evelo Biosciences, Inc. Clinical Trials (Rank 4): Pembrolizumab and EDP1503 in Advanced Melanoma, https://clinicaltrials.gov/ct2/show/NCT03595683?spons=evelo&rank=4.
Evelo Biosciences, Inc. Portfolio: https://evelobio.com/portfolio/.
Evelo Biosciences, Inc. website: https://evelobio.com/science/.
Extended European search report and opinion dated Aug. 23, 2016 for EP Application No. 16166001.4.
Faith et al. Identifying gut microbe-host phenotype relationships using combinatorial communities in gnotobiotic mice. Sci Transl Med 6(220):220ra11 (2014).
Faith et al. The long-term stability of the human gut microbiota. 2013. Science, 341(6141): 1237439.
Falony et al. In vitro kinetics of prebiotic inulin-type fructan fermentation by butyrate-producing colon bacteria: Implementation of online gas chromatography for quantitative analysis of carbon dioxide and hydrogen gas production. Applied and Environmental Microbiology. 2009, vol. 75, No. 18, pp. 5884-5892.
Fanning, S., Hall, L.J., Cronin, M., Zomer, A., MacSharry, J., Goulding, D., et al. (2012). Bifidobacterial surface-exopolysaccharide facilitates commensal-host interaction through immune modulation and pathogen protection. Proc Natl Acad Sci USA 109(6), 2108-2113. doi: 10.1073/pnas.1115621109.
Ferrario, C., Milani, C., Mancabelli, L., Lugli, G.A., Duranti, S., Mangifesta, M., et al. (2016). Modulation of the eps-ome transcription of bifidobacteria through simulation of human intestinal environment. FEMS Microbiol Ecol 92(4), fiw056. doi: 10.1093/femsec/fiw056.
Flores-Langarica et al. (2012) "Systemic flagellin immunization stimulates mucosal CD1 03+ dendritic cells and drives Foxp3+ regulatory T Cell and IgA responses in the mesenteric lymph node," Journal of Immunology. 189 (12):57 45/5754.
Fraley et al. (1986) "Genetic Transformation in Higher Plants," Critical Reviews Plant Science. 4:1-46.
Frame et al., Production of fertile transgenic maize plants by silicon carbide whisker-mediated transformation, The Plant Journal. 1994; 6:941-948.
Gaboriau-Routhiau et al. 'The key role of segmented filamentous bacteria in the coordinated maturation of gut helper T cell responses.' Immunity. 2009, vol. 31, No. 4, pp. 677-689.
Gait, M.J., (1984) Oligonucleotide Synthesis: A Practical Approach. Irl Press. pp. vii-xiii.
GB1612190.7 International Search Report dated Apr. 12, 2017.
GenBank Accession No. AB148297.1 (Jul. 20, 2007) "Fia1 flagellin [*Roseburia* hominis]".

GenBank Accession No. ABY J02000000 (Nov. 8, 2013) Version 2. "*Roseburia intestinal* is L 1-82, whole genome shotgun sequencing project".
GenBank Accession No.'s ABY J02000001—ABY J02000409 search results page (Last Updated Apr. 24, 2015).
GenBank accession No. AJ312385 (Oct. 9, 2002) "*Roseburia intestinalis* 16S rRNA gene, strain L 1-82".
GenBank Accession No. CP003040 (Aug. 5, 2011) Version 1. "*Roseburia* Hominis A2-183, complete genome".
GenBank Accession No. DQ789141. (Jul. 20, 2007) "*Roseburia* hom in is Fla2 flagellin gene".
GenBank Accession No. M20983. (Apr. 26, 1993) "R.cecicola ftagellin gene".
Genbank NCBI Reference Sequence: NR-044054.1, Blautia wexlerae strain DSM 19850 16S ribosomal RNA gene, partial sequence.
Genbank NCBI Reference Sequence: NR_117867.1, Blautia stercoris strain GAMC6-1 16S ribosomal RNA gene, partial sequence.
Genbank NCBI Reference Sequence: NR_026314, Blautia hydrongentrophica strain S5a36 16S ribosomal RNA gene, partial sequence.
Geraedts et al. 'Release of satiety hormones in response to specific dietary proteins is different between human and murine small intestinal mucosa.' Annals of Nutrition and Metabolism. 2010, vol. 56, No. 4, pp. 3018-313.
Geuking et al. 'Intestinal bacterial colonization induces mutualistic regulatory T cell responses.' Immunity. 2011, vol. 34, No. 5, pp. 794-806.
Gewirtz et al. (2001) Cutting edge: bacterial flagellin activates basolaterally expressed TLR5 to induce epithelial proinflammatory gene expression. The Journal of Immunology. 167:(4)1882-1885.
Giraud et al. 'Dissecting the genetic components of adaptation of *Escherichia coli* to the mouse gut.' PLoS Genetics.2008, vol. 4, No. 1, pp. e2.
Gonzalez-Rodriguez, I., Sanchez, B., Ruiz, L., Turroni, F., Ventura, M., Ruas-Madiedo, P., et al. (2012). Role of extracellular transaldolase from *Bifidobacterium bifidum* in mucin adhesion and aggregation. Appl Environ Microbiol 78(11), 3992-3998. doi: 10.1128/AEM.08024-11.
Gopal, P.K., Sullivan, P.A., Smart, J.B. Utilization of galacto-oligosaccharides as selective substrates for growth by lactic acid bacteria including *Bifidobacterium lactis* DR10 and *Lactobacillus rhamnosus* DR20 (2001). International Dairy Journal, 11 (1-2), pp. 19-25.
Gousia, P. et al., Antimicrobial resistance of major foodborne pathogens from major meat products (2011). Foodborne Pathogens and Disease, 8 (1), pp. 27-38.
Greenspan et al., Defining epitopes: It's not easy as it seems. Nature Biotechnology 7: 936-937, 1999.
Groeger, D., O'Mahony, L., Murphy, E.F., Bourke, J.F., Dinan, T.G., Kiely., et al. (2013). *Bifidobacterium infantis* 35624 modulates host inflammatory process beyond the gut. Gut Microbes 4(4), 325-339. doi: 10.4161/gmic.25487.
GT Biologics obtains FDA orphan drug designation for paediatric crohn's drug, pharmaceutical-technology.com news, Oct. 8, 2013. Available at: http://www.pharmaceutical-technology.com/news/newsgt-biologics-obtains-fda-orphan-drug-designation-for-paediatric-crohns-drug?WT.mc_id=DN_News.
Hansen, et al., THe role of Mucosal immunity and host genetics in definging intestinal commensal bacteria. 2010. Curr. Opin. Gastroenterol., 26(6): 564-571.
Hapfelmeier et al. 'Reverse microbial colonization of germ-free mice reveals the dynamics of IgA immune responses.' Science. 2010, vol. 328, No. 5986, pp. 1705-1709.
Hayashi et al. The innate immune response to baterial ftagellin is mediated by Toll-like receptor 5.' Nature. 2001, vol. 410, No. 6832, pp. 1099-1103.
Heberle, H., Meirelles, G.V., da Silva, F.R., Telles, G.P., and Minghim, R. (2015). InteractiVenn: a web-based tool for the analysis of sets through Venn diagrams. BMC Bioinformatics 16(1), 169, doi: 10.1186/s12859-015-0611-3.
Hedayat et al. (Mar. 1, 2012) "Prophylactic and therapeutics implications of toll-like receptor ligands," Medicinal Research Reviews, 32(2):294-325.

(56) References Cited

OTHER PUBLICATIONS

Heuvelin, E., Lebreton, C., Grangette, C., Pot, B., Cerf-Bensussan, N., and Heyman, M. (2009). Mechanisms Involved in Alleviation of Intestinal Inflammation by Bifidobacterium Breve Soluble Factors. PLOS ONE 4(4), e5184. doi: 10.1371/journal.pone.0005184.
Hidalgo-Cantabrana, C., Lopez, P., Gueimonde, M., de Los Reyes-Gavilan, C.G., Suarez, A., Margolles, A., et al. (2012). Immune Modulation Capability of Exopolysaccharides Synthesised by Lactic Acid Bacteria and Bifidobacteria. Probiotics Antimicrob Proteins 4(4), 227-237. doi: 10.1007/s12602-012-9110-2.
Hidalgo-Cantabrana, C., Sanchez, B., Alvarez-Martin, P., Lopez, P., Martinez-Alvarez, N., Delley, M., et al. (2015). A single mutation in the gene responsible for the mucoid phenotype of Bifidobacterium animalis subsp. lactis confers surface and functional characteristics. Appl Environ Microbiol 81(23), 7960-7968. doi: 10.1128/AEM.02095-15.
Hidalgo-Cantabrana, C., Sanchez, B., Milani, C., Ventura, M., Margolles, A., and Ruas-Madiedo, P. (2014). Genomic overview and biological functions of exopolysaccharide biosynthesis in Bifidobacterium spp. Appl Environ Microbiol 80(1), 9-18. doi: 10.1128/AEM.02977-13.
Higgins, et al. Clustal: A Package for Performing Multiple Sequence Alignment on a Microcomputer. Gene. 73 (1988): 237-244.
Hinchliffe (1993) "Yeast as a vehicle for the expression of heterologous genes," Yeasts. 2nd edition. Rose, A. R.; Harrison, J. H.: Eds. Academic Press Ltd. 5(9). pp. 325-356.
Hinnen et al., Transformation of yeast, Proc. Natl. Acad. Sci. USA. Apr. 1978; 75:1929-1933.
Hoekema (1985) The Binary Plant Vector System Offset-drukkerij Kanters BB, Alblasserdam. Chapter V. pp. 63-71.
Hold et al. 'Oligonucleotide probes that detect quantitatively significant groups of butyrate-producing bacteria in human feces.' Applied and environmental microbiology. 2003, vol. 69, No. 7, pp. 4320-4324.
Holland et al. (1990) "Secretion of Heterologous Proteins in *Escherichia coli*," Methods Enzymology. 182:132-143.
Hollenberg et al. (1997) "Production of recombinant proteins by methulotrophic yeasts," Current Opinion Biotechnology. 8(5):554-560.
Hooper at al. 'Molecular analysis of commensal host-microbial relationships in the intestine.' Science. 2001; vol. 291, No. 5505, pp. 881-884.
Horn, et al., Synthesis of Oligonucleotides on Cellulose. Part II: Design and Synthetic Strategy to the Synthesis of 22 Oligodeoxynucleotides Coding for Gastric Inhibitory Polypeptide (GIP). 1980. Nuc Acids Res Symp Ser 225-232.
Horwell, et al., The 'peptoid' approach to the design of non-peptide, small molecule agonists and antagonists of neuropeptides. 1995. Trends Biotechnol. 13(4):132-134.
Hossain et al. "Flagellin, a TLRs agonist, reduces graft-versus-host disease in allogeneic hematopoietic stem cell transplantation recipients while enhancing antiviral immunity," Journal of Immunology. Nov. 2011; 187(10): p. 5130-5140.
Hoyles L. et al. Gastrointestinal Tract, Chapter 56. Handbook of Hydrocarbon and Lipid Microbiology Springer Verlag Berlin 2010, 3120-32.
Hughes, K.R., Harnisch, L.C., Alcon-Giner, C., Mitra, S., Wright, C.J., Ketskemety, J., et al. (2017). Bifidobacterium breve reduces apoptotic epithelial cell shedding in an exopolysaccharide and MyD88-dependent manner. Open Biol 7(1). doi: 10.1098/rsob.160155.
Hytönen, J., Haataja, S., and Finne, J. (2003). *Streptococcus pyogenes* Glycoprotein-Binding Strepadhesin Activity Is Mediated by a Surface-Associated Carbohydrate-Degrading Enzyme, Pullulanase. Infection and Immunity 71(2), 784-793.
Hytonen, J., Haataja, S., and Finne, J. (2006). Use of flow cytometry for the adhesion analysis of *Streptococcus pyogenes* mutant strains to epithelial cells: investigation of the possible role of surface pullulanase and cysteine protease, and the transcriptional regulator Rgg. BMC Microbiol 6, 18. doi: 10.1186/1471-2180-6-18.

Ibrahim et al., "Method for the isolation of highly purified *Salmonella* flagellins," Journal of Clinical Microbiology. Dec. 1985; 22(6):1040-1044.
Inaba et al., "Generation of large numbers of dendritic cells from mouse bone marrow cultures supplemented with granulocyte/macrophage colony-stimulating factor," J. Exp. Med. Dec. 1992; 176(6):1693-1702.
International Search Report for International Application No. PCT/GB2012/052495, dated Mar. 25, 2013.
International Preliminary Report dated Mar. 1, 2017 for International Application No. PCT/GB2015/054113.
International Preliminary Report on Patentability corresponding to International Patent Application No. PCT/GB2014/051123, dated Oct. 13, 2015.
International Preliminary Report on Patentability for International Application No. PCT/GB2012/051686 dated Jan. 14, 2014.
International Search Report dated Feb. 10, 2016 for International Application No. PCT/GB2015/054113.
International Search Report dated Mar. 7, 2016 for International Application No. PCT/GB2015/054112.
International Search report dated Mar. 15, 2003 for International Application No. PCT/GB2002/05255.
International Search Report dated Aug. 21, 2014 for International Application No. PCT/GB2014/051123.
International Search Report for International Application No. PCT/GB2012/051686 dated Jan. 31, 2013.
International search report with written opinion dated Jun. 8, 2017 for GB Application No. 1616016.
International search report with written opinion dated Sep. 29, 2017 for GB Application No. 1621123.
International search report with written opinion dated Oct. 16, 2017 for PCT/GB2017/052076.
Inturri, R., Molinaro, A., Di Lorenzo, F., Blandino, G., Tomasello, B., Hidalgo-Cantabrana, C., et al. (2017). Chemical and biological properties of the novel exopolysaccharide produced by a probiotic strain of *Bifidobacterium longum*. Carbohydr Polym 174, 1172-1180. doi: 10.1016/j.carbpol.2017.07.039.
Israel, E. et al., Supplementary Appendix, Severe and difficult-to-treat asthma in adults. N. Engl J Med 2017;p377:965-76. DOI: 10.1056/NEJMra1608969.
Israel, et al., Severe and difficult-to-treat asthma in adults, The New England Journal of Medicine, Sep. 2017; 377(10):965-976.
Issue Notification dated Feb. 20, 2019 for Co-Pending U.S. Appl. No. 15/631,945.
Ito et al. (1983) "Transformation of Intact Yeast Cells Treated with Alkali Cations," J. Bacteriology. 153:163-168.
Ivanov, D., Emonet, C., Foata, F., Affolter, M., Delley, M., Fisseha, M., et al. (2006). A serpin from the gut bacterium *Bifidobacterium longum* inhibits eukaryotic elastase-like serine proteases. J Biol Chem 281(25), 17246-17252. doi: 10.1074/jbc.M601678200.
Ivanov et al. 'Induction of intestinal Th17 cells by segmented filamentous bacteria.' Cell. 2009, vol. 139, No. 3, pp. 485-498.
Jackson MS, Bird AR, McOrist AL. Comparison of two selective media for the detection and enumeration of Lactobacilli in human faeces (2002). J Microbial Methods. 51 (3), pp. 313-21.
Jarchum et al., "Toll-Like Receptor 5 Stimulation Protects Mice from Acute Clostridium difficile Colitis," Infection and Immunity. Apr. 2011; 79(4):1498-1503.
Jenq, Robert R., Intestinal Blautia is associated with reduced death from graft versus-host disease, Bio Blood Marro Transplant. Aug. 2015 21(8): 1373-1383. doi:10.1016/j.bbmt.2015.04.016.
Jeon, S.G., Kayama, H., Ueda, Y., Takahashi, T., Asahara, T., Tsuji, H., et al. (2012). Probiotic *Bifidobacterium breve* induces IL-10-producing Tr1 cells in the colon. PLoS Pathog 8(5), e1002714. doi: 10.1371/journal.ppat.1002714.
Joblin K N., "Ruminal Acetogens and Their Potential to Lower Remnant Methane Emissions." Australian Journal of Agricultural Research. vol. 50. No. 8. 1999, pp. 1307-1313. XP001010439.
Keller et al.. "DNA Probes", 1994. Stockton Press. New York. XP002158943 108660 pp. 594-596.
Kelly et al. 'Commensal anaerobic gut bacteria attenuate inflammation by regulating nuclear-cytoplasmic shuttling of PPAR-y and ReIA.' Nature Immunology. 2003, vol. 5, No. 1, pp. 104-112.

(56) References Cited

OTHER PUBLICATIONS

Kingsley M. A Personalized Approach to Managing 18D. Gastroenterology and Hepatology 12(5)308-315, May 2016.
Kinnebrew et al., Interleukin 23 production by intestinal CD1 03(+)CD11 b(+) dendritic cells in response to Interleukin 23 production by intestinal CD1 03(+)CD11 b(+) dendritic cells in response to bacterial flagellin enhances mucosal innate immune defense, Immunity. 2012; 36(2): 276-287.
Kinoshita, H., Uchida, H., Kawai, Y., Kawasaki, T., Wakahara, N., Matsuo, H., et al. (2008). Cell surface *Lactobacillus plantarum* LA 318 glyceraldehyde-3-phosphate dehydrogenase (GAPDH) adheres to human colonic mucin. J Appl Microbiol 104(6), 1667-1674. doi: 10.1111/j.1365-2672.2007.03679.x.
Kishimoto, M., Nomoto, R., Mizuno, M., and Osawa, R. (2017). An in vitro investigation of immunomodulatory properties of *Lactobacillus plantarum* and L. delbrueckii cells and their extracellular polysaccharides. Bioscience of Microbiota, Food and Health 36(3), 101-110. doi: 10.12938/bmfh.17-001.
Kitahara et al., *Bacteroides plebeius* sp. nov. and *Bacteroides coprocola* sp. nov., isolated from human faeces, 2005; Int J Syst Ev Microbiol 55: 2143-47.
Koh, Gar Yee et al., Parabacteroides distasonis attenuate toll-like receptor 4 signalling and Akt activation and blocks colon tumor formulation in high-fat-diet-fed azoxymethane-treated mice, International Journal of Cancer, pp. 1-30. Accepted Article, doi: 10.1002/ijc.31559.
Korhonen, J.M., Sclivagnotis, Y., Von Wright, A Characterization of dominant cultivable lactobacilli and their antibiotic resistance profiles from faecal samples of weaning piglets (2007). Journal of Applied Microbiology, 103 (6), pp. 2496-2503.
Kumolosasi, E., Salim, E., Jantan, I., and Ahmad, W. (2014). Kinetics of Intracellular, Extracellular and Production of Pro-Inflammatory Cytokines in Lipopolysaccharide- Stimulated Human Peripheral Blood Mononuclear Cells. Tropical Journal of Pharmaceutical Research 13(4), 536-543. doi: 10.4314/tjpr.v13i4.8.
Lahteinen, T., et al., A Pro biotic properties of *Lactobacillus* isolates originating from porcine intestine and feces (20 10) Anaerobe, 16 (3), pp. 293-300.
Lakhdari, et al. Identification of NF-KB Modulation Capabilities within Human Intestinal Commensal Bacteria. J Biomed Biotechnol. 2011; 2011: 282356.
Lavallie et al. (1995) "Gene fusion expression systems in *Escherichia coli*," Current Opinion Biotechnology. 6 (5):501-506.
Law, J., Buist, G., Haandrikman, A., Kok, J., Venema, G., and Leenhouts, K. (1995). A system to generate chromosomal mutations in *Lactococcus lactis* which allows fast analysis of targeted genes. Journal of Bacteriology 177(24), 7011-7018.
Lebeer, S., Claes, I.J., Verhoeven, T.L., Vanderleyden, J., and De Keersmaecker, S.C. (2011). Exopolysaccharides of *Lactobacillus rhamnosus* GG form a protective shield against innate immune factors in the intestine. Microb Biotechnol 4(3), 368-374. doi: 10.1111/j.1751-7915.2010.00199.x.
Lebeer, S., Verhoeven, T.L., Francius, G., Schoofs, G., Lambrichts, I., Dufrene, Y., et al. (2009). Identification of a Gene Cluster for the Biosynthesis of a Long, Galactose-Rich Exopolysaccharide in *Lactobacillus rhamnosus* GG and Functional Analysis of the Priming Glycosyltransferase. Appl Environ Microbiol 75(11), 3554-3563. doi: 10.1128/AEM.02919-08.
Leser et al. 'Culture-independent analysis of gut bacteria: the pig gastrointestinal tract microbiota revisited'. Applied and Environmental Microbiology. 2002, vol. 68, No. 2, pp. 673-690.
Letran et al. 'TLR5-deficient mice lack basal inflammatory and metabolic defects but exhibit impaired CD4 T cell responses to a flagellated pathogen.' The Journal of Immunology. 2011, vol. 186, No. 9, pp. 5406-5412.
Li, C.Y., Lin Hc Fau—Lai, C.-H., Lai Ch Fau—Lu, J.J.-Y., Lu Jj Fau—Wu, S.-F., Wu Sf Fau—Fang, S.-H., and Fang, S.H. (2011). Immunomodulatory effects of *lactobacillus* and *Bifidobacterium* on both murine and human mitogen-activated T cells. Int Arch Allergy Immunol 156(2), 128-136. doi: 10.1159/000322350.
Li, et al,. Screening and Identification of *Lactobacillus animalis* strain and characteristics of its bacteriostatic protein, Weishengwuxue Tongbao 2009; 36(7): 1001-1007.
Lilley et al., Methods in Enzymology; DNA Structure Part A: Synthesis and Physical Analysis of DNA. 1992; vol. 2011. pp. v-vii.
Liu, Y., et al., Human-derived probiotic *Lactobacillus reuteri* strains differentially reduce intestinal inflannuation (20 10). American Journal of Physiology- Gastrointestinal and Liver Physiology, 299 (5), pp. G1087-G1096.
Ljungh, A, Wadstrorn, T. Lactic acid bacteria as probiotics (2006). Current Issues in Intestinal Microbiology, 7 (2), pp. 73-90.
Lopez, P., Gonzalez-Rodriguez, I., Sanchez, B., Ruas-Madiedo, P., Suarez, A., Margolles, A., et al. (2012). Interaction of *Bifidobacterium bifidum* LMG13195 with HT29 cells influences regulatory-T-cell-associated chemokine receptor expression. Appl Environ Microbiol 78(8), 2850-2857. doi: 10.1128/AEM.07581-11.
Lopez-Boado, Y. S. et al., Bacterial Exposure Induces and Activates Matrilysin in Mucosal Epithelial Cells. J Cell Biol148, 1305-1315 (2000).
Louis et al. 'Diversity, metabolism and microbial ecology of butyrate-producing bacteria from the human large Intestine.' FEMS Microbiology Letters. 2009, vol. 294, No. 1, pp. 1-8.
Louis et al. 'Diversity of human colonic butyrate- producing bacteria revealed by analysis of the butyryl-GoA: acetate GoA-transferase gene.' Environmental Microbiology. 2010, vol. 12, No. 2, pp. 304-314.
Louis et al. 'Organization of butyrate synthetic genes in human colonic bacteria: phylogenetic conservation and horizontal gene transfer.' FEMS Microbiology Letters. 2007, vol. 269, No. 2, pp. 240-247.
López, P., González-Rodriguez, I., Gueimonde, M., Margolles, A., and Suárez, A. (2011). Immune Response to *Bifidobacterium bifidum* Strains Support Treg/Th17 Plasticity. PLOS ONE 6(9), e24776. doi: 10.1371/journal.pone.0024776.
López, P., Gueimonde, M., Margolles, A., and Suárez, A. (2010). Distinct *Bifidobacterium* strains drive different immune responses in vitro. International Journal of Food Microbiology 138(1), 157-165. doi: https://doi.org/10.1016/j.ijfoodmicro.2009.12.023.
Álvarez-Martin, P., O'Connell-Motherway, M., van Sinderen, D., and Mayo, B. (2007). Functional analysis of the pBC1 replicon from *Bifidobacterium catenulatum* L48. Applied Microbiology and Biotechnology 76(6), 1395. doi: 10.1007/s00253-007-1115-5.
Machiels, et al., Predominant dysbiosis in patients with ulcerative colitis is different from Crohn's disease patients, Inflammatory Bowel Diseases, Microbiology 2012. 8th Congress of ECCO. (This Abstract Is In 7th Congress 2012).
Macpherson et al. 'IgA adaptation to the presence of commensal bacteria in the intestine.' Gut-Associated Lymphoid Tissues. Springer Berlin Heidelberg, 2006. 117-136.
Mahowald et al. 'Characterizing a model human gut microbiota composed of members of its two dominant bacterial phyla.' Proceedings of the National Academy of Sciences. 2009, vol. 106, No. 14, pp. 5859-5864.
Mallya et al. 'Characterization of the five novel Ly—6 superfamily members encoded in the MHC, and detection of cells expressing their potential ligands.' Protein Science. 2006, vol. 15, No. 10, pp. 2244-2256.
Martin et al., Cloning, Nucleotide Sequence, and Taxonomic Implications of the Flagellin Gene of *Roseburia cecicola*, Journal of Bacteriology. Jun. 1988; 170(6):2612-2617.
Martin R. et al., Isolation of lactobacilli from sow milk and evaluation of their probiotic potential. J of dairy research 76(4)418-425. Nov. 2009.
Matthes, et al., Simultaneous rapid chemical synthesis of over one hundred oligonucleotides on a microscale. Apr. 1984. EMBO Journal, 3(4): p. 801-805.
McCarville, J.L., Dong, J., Caminero, A., Bermudez-Brito, M., Jury, J., Murray, J.A., et al. (2017). A Commensal *Bifidobacterium longum* Strain Prevents Gluten-Related Immunopathology in Mice through Expression of a Serine Protease Inhibitor. Applied and Environmental Microbiology 83(19), e01323-01317. doi: 10.1128/AEM.01323-17.

(56) References Cited

OTHER PUBLICATIONS

McClymont, S.A., Putnam Al Fau—Lee, M.R., Lee Mr Fau—Esensten, J.H., Esensten Jh Fau—Liu, W., Liu W Fau—Hulme, M.A., Hulme Ma Fau—Hoffmuller, U., et al. (2011). Plasticity of human regulatory T cells in healthy subjects and patients with type 1 diabetes. Journal of Immunology 186(7), 3918-3926. doi: 10.4049/jimmunol.1003099.
McIntosh et al. 'Mechanism of conjugated linoleic acid and vaccenic acid formation in human faecal suspensions and pure cultures of intestinal bacteria.' Microbiology. 2009, vol. 155, No. 1, pp. 285-294.
Mclaughlin., "Mclaughlin et al. Fatty acid chain length determines cholecystokinin secretion and effect on human gastric motility. Gastroenterology. 1999, vol. 116, No. 1, pp. 46-53".
Menard, S., Laharie D Fau—Asensio, C., Asensio C Fau—Vidal-Martinez, T., Vidal-Martinez T Fau—Candalh, C., Candalh C Fau—Rullier, A., Rullier A Fau—Zerbib, F., et al. (2005). *Bifidobacterium breve* and *Streptococcus thermophilus* secretion products enhance T helper 1 immune response and intestinal barrier in mice. Experimental Biology and Medicine (Maywood) 230(10), 749-756.
Meyer et al. (1992) "The use of cassava mosaic virus as a vector system for plants," Gene. 110:213-217.
Meyza, et al. The BTBR mouse model of idiopathic autism—Current view on mechanisms. 2017. Neurosci Biobehav Rev.;76(Pt A):99-110.
Mikayama, et al., Molecular cloning and functional expression of a cDNA encoding glycosylation-inhibiting factor. Proc.Nati.Acad. Sci. USA, Nov. 1993; vol. 90: 10056-1 0060.
Milani, C., Mangifesta, M., Mancabelli, L., Lugli, G.A., Mancino, W., Viappiani, A., et al. (2017). The Sortase-Dependent Fimbriome of the Genus *Bifidobacterium*: Extracellular Structures with Potential to Modulate Microbe-Host Dialogue. Appl Environ Microbiol 83(19). doi: 10.1128/AEM.01295-17.
Miraglia Del Giudice, M., Indolfi, C., Capasso, M., Maiello, N., Decimo, F., and Ciprandi, G. (2017). *Bifidobacterium* mixture (B longum BB536, B infantis M-63, B breve M-16V) treatment in children with seasonal allergic rhinitis and intermittent asthma. Italian Journal of Pediatrics 43(1), 25. doi: 10.1186/513052-017-0340-5.
Monteleone et al., IL-10-dependent partial refractoriness to Toll-like receptor stimulation modulates gut mucosal dendritic cell function, European Journal of Immunology. 2008; 38(6):1533-1547.
Mortaz, E. et, al., Anti-Inflammatory Effects of *Lactobacillus Rahmosus* and *Bifidobacterium Breve* on Cigarette Smoke Activated Human Mcrophiages, PLoS One, Apr. 21, 2015, 10(8):e0136455.D01:10.1371, Journal.pone.0136455.
Mulder et al. 'Environmentally-acquired bacteria influence microbial diversity and natural innate immune responses at gut surfaces'. Bmc Biology. 2009, vol. 7, No. 1, pp. 79.
Murofushi, Y., Villena, J., Morie, K., Kanmani, P., Tohno, M., Shimazu, T., et al. (2015). The toll-like receptor family protein RP105/MD1 complex is involved in the immunoregulatory effect of exopolysaccharides from *Lactobacillus plantarum* N14. Mol Immunol 64(1), 63-75. doi: 10.1016/j.molimm.2014.10.027.
Naughton PJ; Grant G. (2005) Modelling of salmonellosis in: Microbial Ecology of the Growing Animal Holzapfel WH, Naughton PJ. (Eds). London, Elsevier. pp. 235-257.
Neeser, J.R., et al., *Lactobacillus johnsonii* Lal shares carbohydrate-binding specificities with several enteropathogenic bacteria (2000). Glycobiology, 10 (II), pp. 1193-1199.
Neish, A. S. et al., Prokaryotic Regulation of Epithelial Responses by Inhibition of IκB-+Ubiquitination. Science 289, 1560 (2000).
Neish et al., TLRS in the Gut. II. Flagellin-induced inflammation and antiapoptosis, American Journal of Physiology-Gastrointestinal and Liver Physiology. 2007;292:G462-466.
Nemeth et al. 'Inhibition of *Salmonella*-induced IL-8 synthesis and expression of Hsp70 in enterocyte-like Caco-2 cells after exposure to non-starter lactobacilli'. International Journal of Food Microbiology. 2006, vol. 112, No. 3, pp. 266-274.
Neville, B.A., Functional genomics of motile commensal intestinal bacteria. PhD Thesis. University College Cork. 2013. 281 Pages.
Neville, et al., Characterization of pro-inflammatory flagellin proteins produced by *Lactobacillus ruminis* and related motile Lactobacilli. PloS one. Jul. 2012;7(7):e40592.
Neyrinck et al. 'Dietary modulation of clostridial cluster XIVa gut bacteria (*Roseburia* spp.) by chitin-glucan fiber improves host metabolic alterations induced by high-fat diet in mice.' The Journal of Nutritional Biochemistry. 2012, vol. 23, No. 1, pp. 51-59.
Ng et al., Archaeal flagella, bacterial flagella and type IV pili: a comparison of genes and posttranslation modification, Journal of Molecular Microbiology and Biotechnology. 2006;11:167-191.
Nicolau, D.P. Current challenges in the management of the infected patient (2011). Current Opinion in Infectious Diseases, 24 (Suppl1), pp. SI-S10.
Nutsch et al., T cell tolerance and immunity to commensal bacteria. Current Opinion in Immunology, Aug. 2012; 24 (4):385-391.
O'Connell Motherway, M., Kinsella, M., Fitzgerald, G.F., and Sinderen, D. (2013). Transcriptional and functional characterization of genetic elements involved in galacto-oligosaccharide utilization by *Bifidobecterium breve* UCC2003. Microbial biotechnology 6(1), 67-79. doi: 10.111/175/7915.12011.
O'Connell Motherway, M., O'Driscoll, J., Fitzgerald Gerald, F., and Van Sinderen, D. (2009). Overcoming the restriction barrier to plasmid transformation and target mutagenesis in *Bifidobacterium breve* UCC2003. Microbial Biotechnology 2(3), 321-332. doi: 10.1111/j.1751-7915.2008.0071.x.
O'Connell Motherway, M., Zomer, A., Leahy, S.C., Reunanen, J., Bottacini, F., Claesson, M.J., et al. (2011). Functional genome analysis of *Bifidobacterium breve* UCC2003 reveals type IVb tight adherence (Tad) pili as an essential and conserved host-colonization factor. Proc Natl Acad Sci USA 108(27), 11217-11222. doi: 10.1073/pnas.1105380108.
Odamaki, Toshitaka et al., "Age-related changes in gut microbiota composition from newborn to centenarian: a cross-sectional study," BMC Microbiology (2016) 16:90, pp. 1-12, DOI 10.1186/S12866-016-0708-5.
Ohashi, Y., Ushida, K. Health-beneficial effects of probiotics: Its mode of action (2009). Animal Science Journal, 80 (4), pp. 361-371.
Olivares, M., Castillejo, G., Varea, V., and Sanz, Y. (2014). Double-blind, randomised, placebo-controlled intervention trial to evaluate the effects of *Bifidobacterium longum* CECT 7347 in children with newly diagnosed coeliac disease. British Journal of Nutrition 112(1), 30-40. doi: 10.1017/S0007114514000609.
Olivera et al. 'Nutritional and physiological responses of young growing rats to diets containing raw cowpea seed meal, protein isolate (globulins), or starch.' Journal of agricultural and food chemistry. 2003, vol. 51, No. 1, pp. 319-325.
O'Sullivan et al., "Bacterial Supplementation in the Irritable Bowel Syndrome. A Randomised Double-Blind Placebo-Controlled Crossover Study", Digest Liver Dis. 2000. pp. 294-301.
Overbeek, R., Begley, T., Butler, R.M., Choudhuri, J.V., Chuang, H.-Y., Cohoon, M., et al. (2005). The Subsystems Approach to Genome Annotation and its Use in the Project to Annotate 1000 Genomes. Nucleic Acids Research 33(17), 5691-5702. doi: 10.1093/nar/gki866.
Pang, et al., Crystal structure of human pirin: an iron-binding nuclear protein and transcription cofactor. Journal of Biological Chemistry, 279(2); Jan. 9, 2004:1491-1498.
Paustian, C., Taylor, P., Johnson, T., Xu, M., Ramirez, N., Rosenthal, K.S., et al. (2013). Extracellular ATP and Toll-like receptor 2 agonists trigger in human monocytes an activation program that favors T helper 17. PLoS One 8(1), e54804. doi: 10.1371/journal.pone.0054804.
Coakley M et al: Intestinal bifidobacteria that produce trans-9, trans-11 conjugated linoleicacid: A fatty acid with antiproliferative activity against human colon SW480and HT-29 cancer cells, Nutrition and Cancer, Taylor & Francis Group, US vol. 56, No. 1, Jan. 1, 2006 (Jan. 1, 2006), pp. 95-102, XP008087265, ISSN: 0163-5581, DOI:10.1207/515327914NC5601 13 cf. abstract, p. 101, last para. of the right-hand col.
PCT/EP2017/025038 International Preliminary Report on Patentability dated Jun. 6, 2018, 8 Pages.

(56) References Cited

OTHER PUBLICATIONS

PCT/EP2017/025038 International Search Report and Written Report dated Jun. 12, 2017.
PCT/EP2017/025038 Written Opinion of the International Preliminary Examining Authority dated Jan. 25, 2018.
PCT/GB2017/052076 Written Opinion of the International Preliminary Examining Authority dated Jun. 21, 2018, 11 Pages.
PCT/GB2017/052077 International Search Report dated Oct. 16, 2017.
PCT/GB2017/052077 Written Opinion dated Oct. 16, 2017.
PCT/GB2017/052077 Written Opinion of the International Preliminary Examining Authority dated Jun. 21, 2018, 10 Pages.
Database WPI, Week 201801, Thomson Scientific, London, GB; AN 2017-834299, XP002787097, & WO 2017/209156 Al (Morinaga Milk Ind Co. Ltd) Dec. 7, 2017 (Dec. 7, 2017) of WO2017/2019156, Kobayashi, Youdai et al.
Petersen et al. Intestinal colonization with phylogenetic group B2 *Escherichia coli* related to inflammatory bowel disease: a systematic review and meta-analysis. 2015. Scand J Gastroenterol. ;50(10):1199-207.
Peterson et al. 'Catecholamines increase conjugative gene transfer between enteric bacteria.' Microbial Pathogensis. 2011, vol. 51, No. 1, pp. 1-8.
Petsuriyawong et al. 'Screening of probiotic lactic acid bacteria from piglet feces'. Nature Science. 2011, vol. 45, pp. 245-253.
Hoarau, Cyrille et al., Supernatant from *Bifidobacterium* Differentially Modulates Transduction Signaling Pathways for Biological Functions of Human Dendritic Cells, PLOS ONE, Public Library of Science, US, vol. 3, No. 7, Jul. 1, 2008 (Jul. 1, 2008), pp. e2753-1, XP009139666, ISSN: 1932-6203.
Pinto-Sánchez, M.I., Smecuol, E.C., Temprano, M.P., Sugai, E., Gonzalez, A., Moreno, M.L., et al. (2017). *Bifidobacterium infantis* NLS Super Strain Reduces the Expression of α-Defensin-5, a Marker of Innate Immunity, in the Mucosa of Active Celiac Disease Patients. Journal of Clinical Gastroenterology 51(9), 814-817. doi: 10.1097/mcg.0000000000000687.
Polak J.M. And McGee J.O., In Situ Hybridization: Principles and Practice, Oxford University Press. 1990; pp. vii-viii.
Potrykus (1991) "Gene Transfer to Plants: Assessment of Published Approaches and Results," Annu. Rev. Plant Physiol. Plant Mol. Bioi. 42:205-225.
Prakash, et al., Complete genome sequences of rat and mouse segmented filamentous bacteria, a potent inducer of th17 cell differentiation. Cell Host & Microbe. Sep. 2011;10(3):273-284.
Pryde et al. 'The microbiology of butyrate formation in the human colon.' FEMS Microbiology Letters. 2002. vol. 217, No. 2, pp. 133-139.
Database WPI, Week 201801, Thomson Scientific, London, GB; AN 2017-834299, XP002787097, & WO 2017/209156 Al (Morinaga Milk Ind Co Ltd) Dec. 7, 2017 (Dec. 7, 2017).
Hoarau et al: "TLR2 Activation by Supernatant From *Bifidobacterium Breve* Modulates Maturation and Survival of Human DCs Via Differential Effects on Pl3Kinase, p38 and ERK Pathways", Journal of Allergy and Clinical Immuno, Elsevier, Amsterdam, NL, vol. 119, No. 1, Jan. 1, 2007 (Jan. 1, 2007, p. S258, XP005756921, ISSNn: 0091-6749, DOI: 10.1016/J.JACI.2006.12.377.
Liu, Chang-jian et al., Antioxidant and Cholesterol-Reducing Properties of *Enterococcus gallinarum* m661, Bioengineering (Food Science), vol. 34, No. 7, Dec. 31, 2013, pp. 157-161.
Matsuda F et al: Evaluation of a probiotics, BBG-01, for enhancement of immunogenicity of an oral inactivated cholera vaccine and safety: A randomized, double-blind, placebo-controlled trial in Bangladeshi children under 5 years of age, Vaccine, Elsevier, Amsterdam, NL, vol. 29, No. 10, Dec. 26, 2010 (Dec. 26, 2010), pp. 1855-1858, XP028147184, ISSN: 0264-410X, DOI: 10.1016/J.VACCINE.2010.12.133 [retrieved on Jan. 7, 2011].
Scuotto, Angelo et al., In silico mining and characterization of bifidobacterial lipoprotein with CHHP domain secreted in an aggregated form, International J. of Biol. Macromolecutes 82(2016), 653-662.

Punt et al. (2002) "Filamentous fungi as cell factories for heterologous protein production," Trends Biotechnol. 20 (5):200-206.
Qin et al. 'A human gut microbial gene catalogue established by metagenomic sequencing.' Nature. 2010, vol. 464, No. 7285, pp. 59-65.
Rajilic-Stojanovic, et al. The first 1000 cultures species of the human gastrointestinal micriobiota. FEMS Mlcriobiol Rev, vol. 38, 2014. pp. 996-1047.
Reddy, K.B.P.K., et al., Role of cryoprotectants on the viability and functional properties of pro biotic lactic acid bacteria during freeze drying (2009). Food Biotechnology, 23 (3), pp. 243-265.
Reiff, C. and Kelly, D., Inflammatory bowel disease, gut bacteria and probiotic therapy. International journal of medical microbiology, 2010;300:25-33.
Remington. Remington: The science and practice of pharmacy. 20th Edition. Gennaro, Eds. Lippincott Williams & Wilkins, 2003.
Reuter, G. (2001). The *Lactobacillus* and Bifidobacterium microflora of the human intestine: composition and succession. Current Issues in Intestinal Microbiology 2(2), 43-53.
Rhee et al., Toll-Like Receptor 5 Engagement Modulates Tumor Development and Growth in a Mouse Xenograft Model of Human Colon Cancer. Gastroenterology. Aug. 2008;135(2):518-528.
Rhee, Young-Kyung et al.., Antihumor Activity of *Bifidobacterium* Spp. isolated from a healthy Korean, Arch Pharm Res vol. 23, No. t, 482-487 2000.
Riquelme. Will 4D Pharma be UK's next Microbiome leader? Feb. 2, 2015, LABIOTECH.eu [online].
Robertson, J.M.C., et al., Lack of flagella disadvantages *Salmonella* enterica serovar Enteritidis during the early stages of infection in the rat (2003). Journal of Medical Microbiology, 52 (1), pp. 91-99.
Roe, et al., DNA Isolation and Sequencing: Essential Techniques. John Wiley & Sons, New York, New York. 1996; pp. v-vii.
Rong, Y., Dong, Z., Hong, Z., Jin, Y., Zhang, W., Zhang, B., et al. (2017). Reactivity toward *Bifidobacterium longum* and *Enterococcus hirae* demonstrate robust CD8(+) T cell response and better prognosis in HBV-related hepatocellular carcinoma. Experimental Cell Research 358(2), 352-359. doi: 10.1016/j.yexcr.2017.07.009.
*Roseburia*. Ubiome, 2018. Accessed on Jun. 25, 2018; Available at: https://shop.ubiome.com/pages/roseburia-1.
Round et al. 'The Toll-like receptor 2 pathway establishes colonization by a commensal of the human microbiota.' Science. 2011, vol. 332, No. 6032, pp. 974-977.
Rudinger J, "Characteristics of the amino acids as components of a peptide hormone sequence," Peptide Hormones, JA Parsons Edition, University Park Press, Jun. 1976, pp. 1-7.
Ruiz, L., Delgado, S., Ruas-Madiedo, P., Margolles, A., and Sanchez, B. (2016). Proteinaceous Molecules Mediating *Bifidobacterium*-Host Interactions. Front Microbiol 7, 1193. doi: 10.3389/fmicb.2016.01193.
Ruiz, P.A., Hoffmann, M., Szcesny, S., Blaut, M., and Haller, D. (2005). Innate mechanisms for *Bifidobacterium lactis* to activate transient pro-inflammatory host responses in intestinal epithelial cells after the colonization of germ-free rats. Immunology 115(4), 441-450. doi: 10.1111/j.1365-2567.2005.02176.x.
Russell et al. 'High-protein, reduced-carbohydrate weight-loss diets promote metabolite profiles likely to be detrimental to colonic health.' The American Journal of Clinical Nutrition. 2011, vol. 93, No. 5, pp. 1062-1072.
Saiki, et al., Primer-directed enzymatic amplification of DNA with a thermostable DNA polymerase. 1988. Science, 239. pp. 487-491.
Sakamato, et al., *Parabacteroides faecis* sp. nov., isolated from human faeces. International Journal of Systematic and Evolutionary Microbiology (2015), 65, 1342-1346.
Sakamoto, et al., *Parabacteroides gordonii* sp. nov., isolated from human blood cultures. International Journal of Systematic and Evolutionary Microbiology (2009), 59, 2843-2847.
Sakamoto, et al., *Parabacteroides johnsonii* sp. nov., isolated from human faeces. International Journal of Systematic and Evolutionary Microbiology (2007), 57, 293-296.
Sakamoto Mitsuo et al., Reclassfication of Baceroides distasonis, Bacteroides goldsteinii and *Bacteroides merdae* as Parabacteroides distasonis gen. nov., comb. nov., Parabacteroides goldsteinii comb. nov. and Parabacteroides merdae comb. nov., International Journal

(56) References Cited

OTHER PUBLICATIONS of Systematic and Evolutionary Microbiology (2006) 56, 15/99/1605. DOI 10.1099/ijs.0.0641920.

Salminen et al. 'Probiotics: how should they be defined?.' Trends in Food Science & Technology. 1999, vol. 10, No. 3, pp. 107-110.

Salonen et al., Gastrointestinal microbia in irritable bowel syndrome: present state and perspectives. Microbiology. 2010; 156: 3205-3215.

Schiavi, E., Gleinser, M., Molloy, E., Groeger, D., Frei, R., Ferstl, R., et al. (2016). The Surface-Associated Exopolysaccharide of *Bifidobacterium longum* 35624 Plays an Essential Role in Dampening Host Proinflammatory Responses and Repressing Local TH17 Responses. Appl Environ Microbiol 82(24), 7185-7196. doi: 10.1128/AEM.02238-16.

Schiavi, E., Plattner, S., Rodriguez-Perez, N., Barcik, W., Frei, R., Ferstl, R., et al. (2018). Exopolysaccharide from *Bifidobacterium longum* subsp. longum 35624 modulates murine allergic airway responses. Benef Microbes, 1-14. doi: 10.3920/BM2017.0180.

Schreiber, O, et al., *Lactobacillus reuteri* prevents colitis by reducing P-selectin-associated leukocyte- and plateletendothelial cell interactions (2009). American Journal of Physiology-Gastrointestinal and Liver Physiology, 296 (3), pp. G534-G542.

Schulke et al. (Aug. 26, 2011) "A fusion protein of ftagellin and ovalbumin suppresses the 25 TH2 response and prevents murine intestinal allergy," The Journal of Allergy and Clinical Immunology. 128(6):1340-1348.

Scott et al. 'Substrate-driven gene expression in *Roseburia* inulinivorans: importance of inducible enzymes in the utilization of inulin and starch.' Proceedings of the National Academy of Sciences. 2011, vol. 108, Supp. 1, pp. 672-4679.

Sczesnak, et al., The genome of th17 cell-inducing segmented filamentous bacteria reveals extensive auxotrophy and adaptations to the intestinal environment. Cell Host Microbe. Sep. 2011;10(3):260-272.

Severijnen, A. J. et al., Chronic Arthritis Induced in Rats by Cell Wall Fragments of Eubacterium Species from the Human Intestinal Flora. Infection and Immunity, 1990, vol. 58, No. 2, 523-528.

Shevach et al., Current Protocols in Immunology. John Wiley & Sons. New York, New York. 1992. Table of Contents only, as accessed online at URL: http://www.4u1r.com/products/currentprotocols/immunology_toc.html. [Last Accessed Jun. 18, 2015].

Simon, et al., Peptoids: A modular approach to drug discover, Oct. 1992 PNAS, 89(20):9367-9371.

Sivan, A., Corrales, L., Hubert, N., Williams, J.B., Aquino-Michaels, K., Earley, Z.M., et al. (2015). Commensal *Bifidobacterium* promotes antitumor immunity and facilitates anti-PD-L1 efficacy. Science 350(6264), 1084-1089. doi: 10.1126/science.aac4255.

Skolnick, et al. From genes to protein structure and function: novel applications of computational approaches in the genomic era. Trends Biotechnol. Jan. 2000;18(1):34-9. Review.

Skountzou, et al., *Salmonella* flagellins are potent adjuvants for intranasally administered whole inactivated influenza vaccine. Vaccine. May 2010; 28(24):4103-4112.

Smith, C.L., et al., *Lactobacillus fermentum* BRII and fmcto-oligosaccharide partially reduce jejunal inflammation in a model of intestinal mucositis in rats (2008). Nutrition and Cancer, 60 (6), pp. 757-767.

Sokol et al. '*Faecalibacterium prausnitzii* is an anti-inftammatory commensal bacterium identified by gut microbiota analysis of Crohn disease patients.' Proceedings of the National Academy of Sciences. 2008, vol. 105, No. 43, pp. 6731-16736.

Sokol et al. 'Low counts of *Faecalibacterium prausnitzii* in colitis microbiota.' Inflammatory bowel diseases. 2009, vol. 15, No. 8, pp. 1183-1189.

Song, Yuli et al., *Bacteroides goldsteinii* sp. nov. Isolated from Clinical Specimens of Human Intestinal Origin, J. Clinical Microbiology, Sep. 2005, p. 4522-4527. DOI:10.1128/JCM.43.9.4522-4527.2005.

Sonnenburg, et al., Genomic and Metabolic Studies of the Impact of Probiotics on a Model Gut Symbiont and Host. PLoS Biol 4(12): e413. https://doi.org/10.1371/journal.pbio.0040413.

Written Opinion for PCT/US2017/066709 (Published as WO2018/112365) owned by Evelo Biosciences, Inc.

Stokholm, et al., Maturation of the gut microbiome and risk of asthma in childhood. Nature Communications, 2018; 9(141): 1-10.

Strasser, S. et al., Influence of lyophilization, fluidized bed drying, addition of protectants, and storage on the viability oflactic acid bacteria (2009). Journal of Applied Microbiology, 107 (1), pp. 167-177.

Strus et al. Distinct effects of *Lactobacillus plantarum* KL3OB and *Escherichia coli* 3A1 on the induction and development of acute and chronic inflammation. 2015. Cent Eur J Immunol.40(4):420-30.

Supplement to: Israel, et al., Severe and difficult-to-treat asthma in adults. N. Engl J Med 2017; 377:965-76.

Tahoun, A., Masutani, H., El-Sharkawy, H., Gillespie, T., Honda, R.P., Kuwata, K., et al. (2017). Capsular polysaccharide inhibits adhesion of *Bifidobacterium longum* 105-A to enterocyte-like Caco-2 cells and phagocytosis by macrophages. Gut Pathog 9, 27. doi: 10.1186/s13099-0170177-x.

Tan, Hai-Qin et al., *Parabacteroides chartae* sp. nov., an obligately anaerobic species from wastewater of a paper mill, International Journal of systematic and Evolutionary Microbiology (2012), 62/2613-2617, DOI 10.1099/ijs.0.038000-0.

Tatusova, et al., Erratum to Blast 2 Sequences, a new tool for comparing protein and nucleotide sequences [FEMS Microbiol. 174 (1999) 247-250], FEMS Microbial. Lett. 1999;177(1):187-188.

Tatusova et al., BLAST 2 Sequences, a new tool for comparing protein and nucleotidesequences, FEMS Microbiology Letters 174 (1999) 247-250.

Tatusova et al., Erratum to BLAST 2 Sequences, a new tool for comparing protein and nucleotide sequences, FEMS Microbiology Letters 177 (1999) 187-188.

Teng, L. J. et al., PCR Assay for Species-Specific Identification of *Bacteroides thetaiotaomicron*. J Clin Microbiol38, 1672-1675 (2000).

Terciz, Janos et al., Inflammation and Colon Cancer, Gastroenterology, 2010: 138: 2101-2114.

Tilg, et al., *Roseburia* hominis: a novel guilty player in ulcerative colitis pathogenesis? Gut, Oct. 14, 2013;63(8)1204-1205.

Tomas, M.S.J., et al., Stability of freeze-dried vaginal *Lactobacillus* strains in the presence of different lyoprotectors (2009). Canadian Journal of Microbiology, 55 (5), pp. 544-552.

Tomosada, Y., Villena, J., Murata, K., Chiba, E., Shimazu, T., Aso, H., et al. (2013). Immunoregulatory Effect of Bifidobacteria Strains in Porcine Intestinal Epithelial Cells through Modulation of Ubiquitin-Editing Enzyme A20 Expression. PLOS ONE 8(3), e59259. doi: 10.1371/journal.pone.0059259.

Travis, et al. Complete genome sequence of the human gut symbiont *Roseburia* hominis. Genome announcements. 2015; 3(6):e01286-15.

Tremaroli, et al., A role for the gut microbiota in energy harvesting? Gut. Dec. 2010; 59(12):1589-1590.

Trueman (1995) "Heterologous Expression in Yeast," Methods Molecular Biology. 49:341-354.

Turnbaugh et al. A core gut microbiome in obese and lean twins. Jan. 22, 2009 Nature, 457(7228): 480-484.

Turnbaugh, et al., An obesity-associated gut microbiome with increased capacity for energy harvest. Nature. Dec. 2006;444(7122):1027-1031.

Turnbaugh et al., Diet-induced obesity is linked to marked but reversible alterations in the mouse distal gut microbiome. Cell Host & Microbe. Apr. 2008;3(4):213-223.

Turner (1994) "Vectors for genetic manipulation," In; Martinelli, S.D.; Kinghorn J. R.: Eds. Aspergillus: 50 years on. Progress in industrial microbiology. vol. 29. Elsevier. Amsterdam, The Netherlands. pp. 641-666.

Turroni, F., Taverniti V Fau—Ruas-Madiedo, P., Ruas-Madiedo P. Fau—Duranti, S., Duranti S Fau—Guglielmetti, S., Guglielmetti S Fau—Lugli, G.A., Lugli Ga Fau—Gioiosa, L., et al. (2014). *Bifidobacterium bifidum* PRL2010 modulates the host innate immune response. Appl Environ Microbiol 80(1098-5336 (Electronic)), 730-740.

(56) References Cited

OTHER PUBLICATIONS

Tzortzis, G., et al., Modulation of anti-pathogenic activity in canine-derived *Lactobacillus* species by carbohydrate growth substrate (2004). Journal of Applied Microbiology, 96 (3), pp. 552-559.
Ukena, et al., Probiotic *Escherichia coli* Nissle 1917 inhibits leaky gut by enhancing mucosal integrity, PloS one. Dec. 2007;2(12):e1308.
Untergasser, A., Nijveen, H., Rao, X., Bisseling, T., Geurts, R., and Leunissen, J.A. (2007). Primer3Plus, an enhanced web interface to Primer3. Nucleic Acids Res 35(Web Server issue), W71-74. doi: 10.1093/nar/gkm306.
Untergasser, et al., Primer3Plus, an enhanced web interface to Primer3, Nucleic Acids Res. 2007;35(Web Server issue):W71-W74.
van de Pol, M.A. et al., Sybiotics reduce allergen-induced T-helper 2 respond and improve peak expiatory flow in allergic asthmatics, Allergy 2011;66:39-47.
Van Immerseel et al. 'Butyric acid-producing anaerobic bacteria as a novel probiotic treatment approach for inflammatory bowel disease.' Journal of medical microbiology. 2010, vol. 59, No. 2, pp. 141-143.
Van Nevel et al., "Control of Rumen Methanogenesis." Environmental Monitoring and Assessment. vol. 42, 1996, pp. 73097, XP000979267.
Verheijden, K.A.T. et al., The development of allergic inflammation in a murine house dust mite asthma is suppressed by symbiotic mixtures of non-digestible oligosaccharides and *Bifidobacterium breve* M-16V; Eur. J. Nut. (2016) 55: 1141-1151, DOI 10.1007, 500394-015-0928-8.
Vijay-Kumar, et al., Deletion of TLR5 results in 10 spontaneous colitis in mice. The Journal of Clinical Investigation. Dec. 2007;117(12):3909-3921.
Vijay-Kumar et al., Flagellin Treatment Protects against Chemicals, Bacteria, Viruses, and Radiation. The Journal of Immunology. 2008;180(12):8280-8285.
Walker et al. 'Dominant and diet-responsive groups of bacteria within the human colonic microbiota.' The ISME Journal. 2010, vol. 5, No. 2, pp. 220-230.
Wang, Chun-Sai-Er, et al., VSL#3 can prevent ulcerative colitis-associated carcinogenesis in mice, Oct. 7, 2018, vol. 24, Issue 37, pp. 4254-4262.
Wang et al. 16S rRNA gene-based analysis of fecal microbiota from preterm infants with and without necrotizing enterocolitis. 2009. ISME J. 3(8): 944-954.
Wang, Feng, *Bifidobacterium* can mitigate intestinal immunopathology in the context of CTLA-4 blockade, PNA, Jan. 2, 2018 vol. 115, No. 1, pp. 157-161.
Wang, G., Xia, Y., Cui, J., Gu, Z., Song, Y., Q., C.Y., et al. (2014). The Roles of Moonlighting Proteins in Bacteria. Current Issues in Molecular Biology 16, 15-22.
Wang, R.F., and Kushner, S.R. (1991). Construction of versatile low-copy-number vectors for cloning, sequencing and gene expression in *Escherichia coli*. Gene 100, 195-199. doi: https://doi.org/10.1016/0378-1119(91)90366-J.
Wang W., Lyophilization and development of solid protein pharmaceuticals. International J. Pharmaceutics 203: 1-60, 2000.
Watson, et al., Signal transduction in *Campylobacter jejuni*-induced cytokine production. Cellular Microbiology. 2005;7(5):655-665.
Wei, X., Yan, X., Chen, X., Yang, Z., Li, H., Zou, D., et al. (2014). Proteomic analysis of the interaction of *Bifidobacterium longum* NCC2705 with the intestine cells Caco-2 and identification of plasminogen receptors. J Proteomics 108, 89-98. doi: 10.1016/j.jprot.2014.04.038.
Weigel, et al., Comparative analysis of murine marrow-derived dendritic cells generated by Flt3L or GMCSF/IL-4 and matured with immune stimulatory agents on the in vivo induction of antileukemia responses. Blood. Dec. 2002;100(12):4169-4176.

Welman, A.D., and Maddox, I.S. (2003). Exopolysaccharides from lactic acid bacteria: perspectives and challenges. Trends in Biotechnology 21(6), 269-274. doi: https://doi.org/10.1016/S0167-7799(03)00107-0.
Wendler, et al., Identification of a pirin, a novel highly conserved nuclear protein. J. Biol Chem. Mar. 28, 1997; 272(13):8482-9.
Wenzel, S.E., Asthma phenotypes: the evolution from clinical to molecular approaches, Nature medicine, May 2012; 18(5):716-725.
Werth, et al., The transcription factor grainyhead-like 2 regulates the molecular composition of the epithelial apical junctional complex. Development. 2010;37(22):3835-3845.
Westermann, C., Gleinser, M., Corr, S.C., and Riedel, C.U. (2016). A Critical Evaluation of Bifidobacterial Adhesion to the Host Tissue. Front Microbiol 7, 1220. doi: 10.3389/fmicb.2016.01220.
Williams, N. T. Probiotics (2010). American Journal of Health-System Pharmacy, 67 (6), pp. 449-458.
Wilson, et al., The TLR5 ligand flagellin promotes asthma by priming allergic responses to indoor allergens. Nature Medicine. Nov. 2012;18(11):1705-1710.
Written Opinion for PCT/US17/066709 (Published as WO2018112363) owned by Evelo Biosciences, Inc.
Xie et al. Short communication: Modulation of the small intestinal microbial community composition over short-term or long-term administration with *Lactobacillus plantarum* ZDY2013. 2016. Journal Dairy Sci. 99:6913-6921.
Xu, et al., A genomic view of the human-*Bacteroides thetaiotaomicron* symbiosis. Science. Mar. 28, 2003; 299(5615):2074-6.
Xu, et al., Differential development of murine dendritic cells by GM-CSF versus Flt3 ligand has implications for inflammation and trafficking. J. Immunology. 2007;179(11):7577-7584.
Yang, Changa et al., Non-invasive imaging of toll-like receptor 5 expressing using 131 labelled mAb in the mice bearing H22 tumors, Oncol. Lett. 2014., 7(6).1919-1924., Published online Apr. 2, 2014. DOI: 10.3892/ol.2014.2025.
Yao, W., et al., Cultivation-Independent Analysis of the Development of the *Lactobacillus* spp. Community in the Intestinal TractofNewbornPiglets (20ll)Agricultural Sciences in China, 10 (3), pp. 438-447.
Yoon, et al., Structural basis of TLR5-flagellin recognition and signaling. Science. Feb. 2012; 335(6070):859-864.
Yq et al. Therapeutic Modulation of the Gut Microbiota in IBD—More Questions to Be Answered. (2016). J. Dig. Dis., Oct. 15, 1751-2980, 12422, Epub ahead of print.
Yu, Dah-Shyong et al., Bacille Calmette-Guerin can induce cellular apoptosis of urothelial cancer directly through toll-like receptor 7 activation, Kaohsiung Journal of Medical Sciences (2015) 31,391-397.
Yu, N. Y., Wagner, J.R., Laird, M.R., Melli, G., Rey, S., Lo, R., et al. (2010a). PSORTb 3.0: improved protein subcellular localization prediction with refined localization subcategories and predictive capabilities for all prokaryotes. Bioinformatics 26(13), 1608-1615. doi: 10.1093/bioinformatics/btq249.
Yun, J.H., et al., Isolation and characterization of potential pro biotic lactobacilli from pig feces (2009). Journal of Basic Microbiology, 49 (2), pp. 220-226.
Yurdusev, N. et al., Antagonistic Effect Exerted by Three Strictly Anaerobic Strains Against Various Strains of Clostridium Perfringens in Gnotobiotic Rodent Intestines. Can J Microbiol 33, 226-231 (1987).
Yurdusev, N. et al., InfectInunun 57,724-731 (1989).
Zheng, B., van Bergenhenegouwen, J., Overbeek, S., van de Kant, H.J., Garssen, J., Folkerts, G., et al. (2014). *Bifidobacterium breve* attenuates murine dextran sodium sulfate-induced colitis and increases regulatory T cell responses. PLoS One 9(5), e95441. doi: 10.1371/journal.pone.0095441.
Zheng, Bin et al., *Bifodobacterium breve* Attenuates Murine Dexran Doium Sulfate-Induced Colitis and Increases Regulatory T Cell Responses, PLOS ONE, vol. 9, Isue 5, e95441, May 2014.

\* cited by examiner

Total lymphocytes.

Total macrophages.

Lymphocytes %.

Bodyweights

Clinical Scores

FIG. 31 Histological Analysis – Mean Peribronchiolar Infiltration Score

FIG. 32 Histological Analysis – Mean Perivascular Infiltration Score

FIG. 33 Histological Analysis – Mean Inflammatory Score (Average of both Peribronchiolar and Perivascular Infiltration Score)

IL-9 level in lung tissue

IL-17A level in lung tissue

IL-1b level in lung tissue

MIP-2 level in lung tissue

FIG. 48 HDM specific IgG1 in BALF

FIG. 49 HDM specific IgG2a in BALF

FIG. 50 Histological Analysis – Mean Peribronchiolar Infiltration Score

FIG. 51 Histological Analysis – Mean Perivascular Infiltration Score

TNFa level in lung tissue

IL-1a level in lung tissue

IFNg level in lung tissue

KC level in lung tissue

IL-17A level in lung tissue

MIP-1a level in lung tissue

FIG. 64
Visual Template for Histopathology Scoring
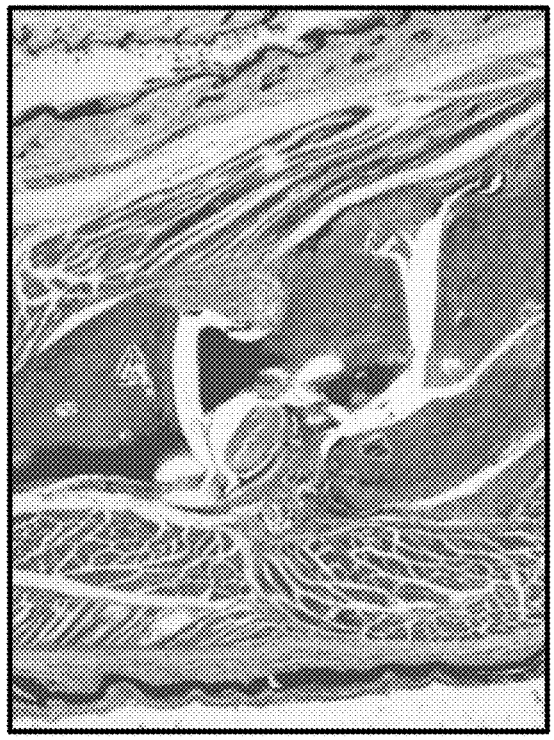
Grade 1
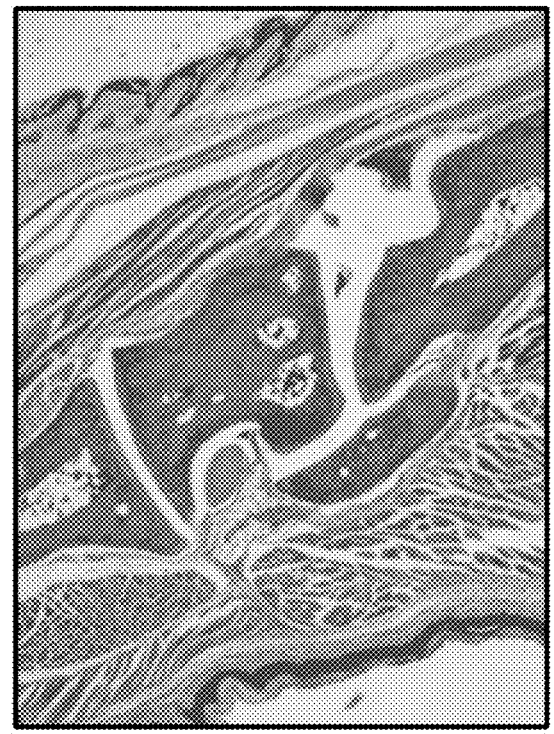
Grade 0

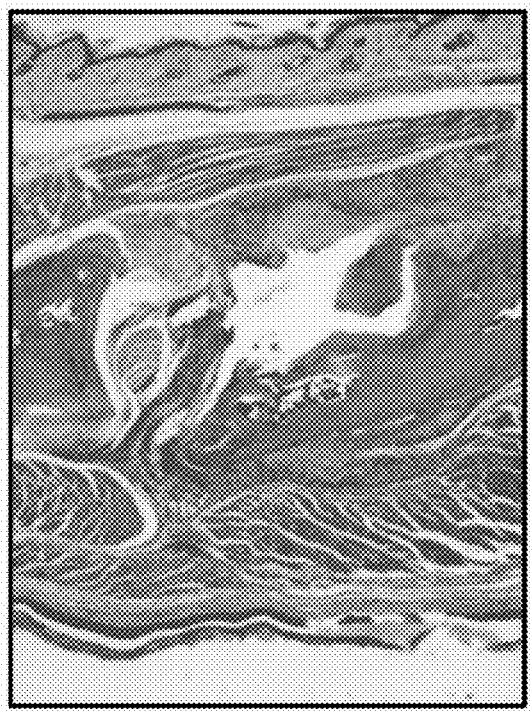
FIG. 64(contd.)
Grade 7
Grade 4

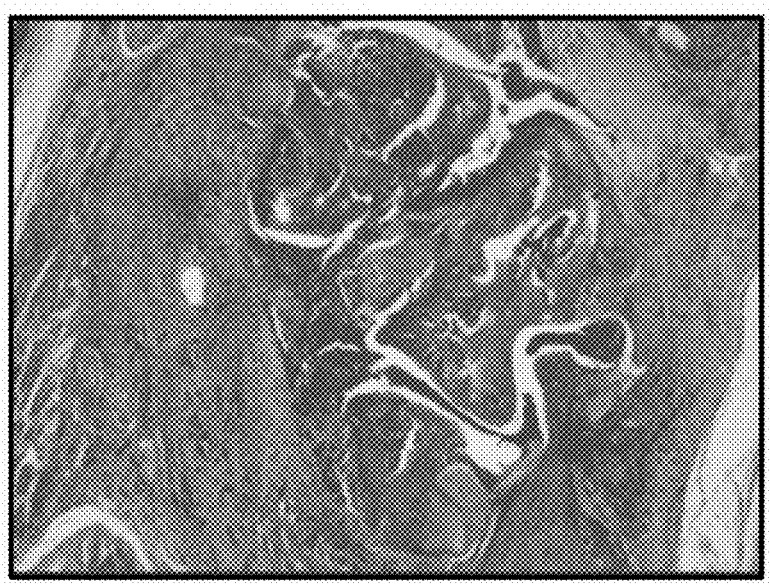
Grade 9
FIG. 64(contd.)

Histopathology: Inflammation Scores

Histopathology: Cartilage Scores

Histopathology: Bone Scores

Histopathology: Total Scores

FIG. 69
Strain #830 (#3.2R, Grade 0)
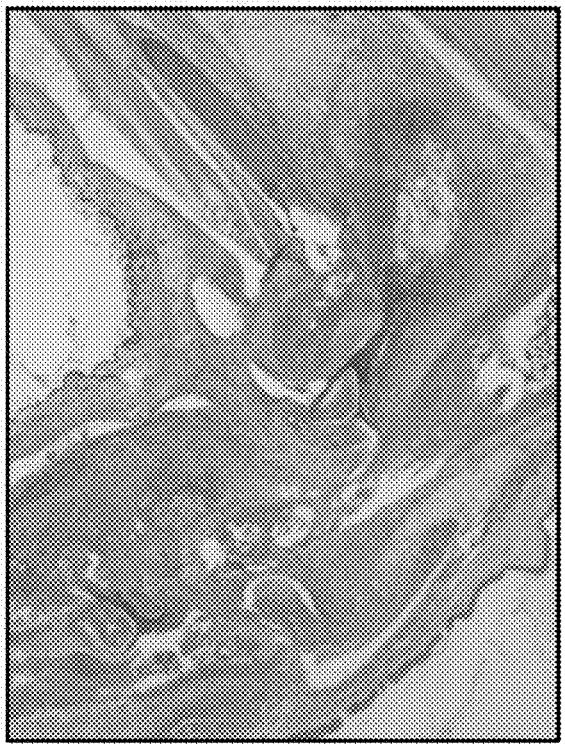
Vehicle (#1.1 1R, Grade 9)

Lymph Node Proliferative Responses to IRBP, Day 21

TEFI Scores

IL-6 Concentration

TNFa Concentration

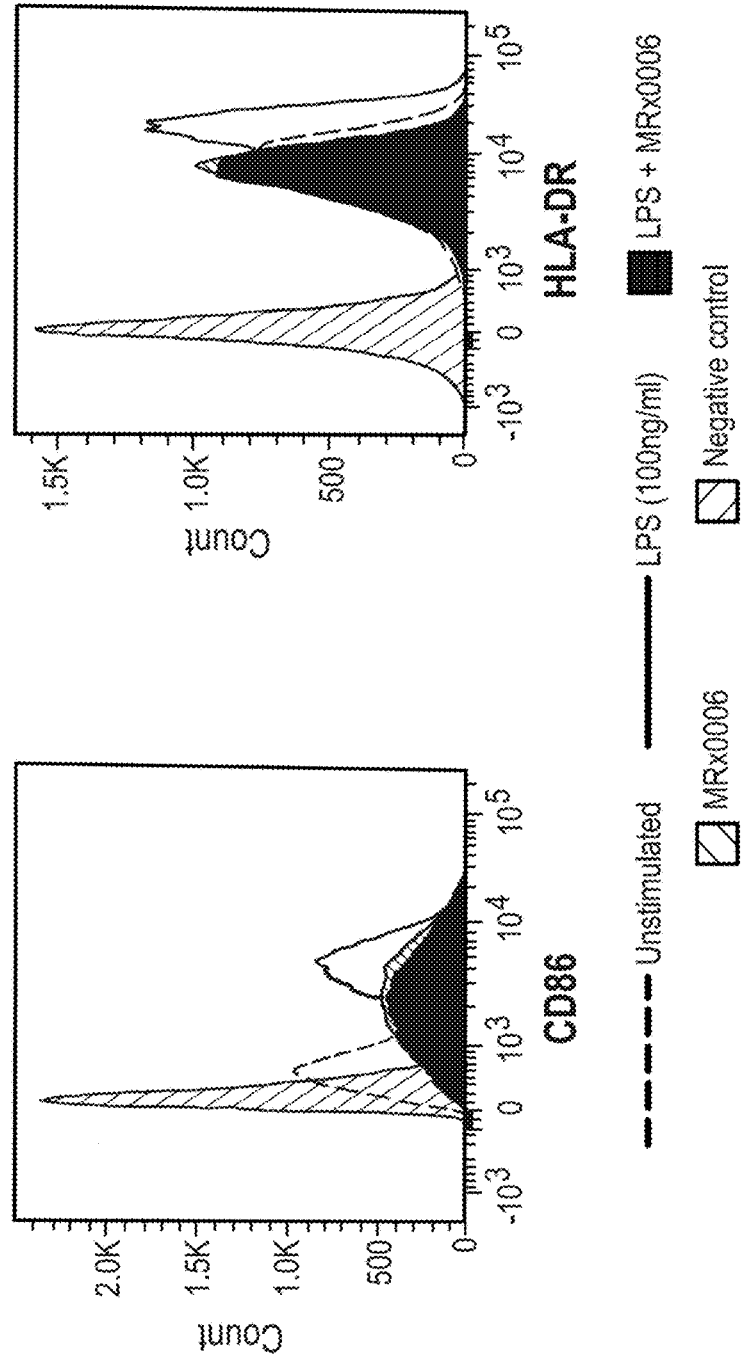
FIG. 77(contd.)
MoDC (Cd1a+ CD14-) maturation

COMPOSITIONS COMPRISING BACTERIAL STRAINS

CROSS-REFERENCE

This application is a continuation of International Application No. PCT/GB2016/051770, filed Jun. 15, 2016, which claims the benefit of Great Britain Application No. 1510466.4, filed Jun. 15, 2015; Great Britain Application No. 1520508.1, filed Nov. 20, 2015; Great Britain Application No. 1606810.8, filed Apr. 19, 2016, which are hereby incorporated by reference in their entirety.

SEQUENCE LISTING

The instant application contains a Sequence Listing which has been submitted electronically in ASCII format and is hereby incorporated by reference in its entirety. Said ASCII copy, created on Jun. 5, 2017, is named 49455-716 301 SL.txt and is 4,456,957 bytes in size.

TECHNICAL FIELD

This invention is in the field of compositions comprising bacterial strains isolated from the mammalian digestive tract and the use of such compositions in the treatment of disease.

BACKGROUND TO THE INVENTION

The human intestine is thought to be sterile in utero, but it is exposed to a large variety of maternal and environmental microbes immediately after birth. Thereafter, a dynamic period of microbial colonization and succession occurs, which is influenced by factors such as delivery mode, environment, diet and host genotype, all of which impact upon the composition of the gut microbiota, particularly during early life. Subsequently, the microbiota stabilizes and becomes adult-like [1]. The human gut microbiota contains more than 500-1000 different phylotypes belonging essentially to two major bacterial divisions, the Bacteroidetes and the Firmicutes [2]. The successful symbiotic relationships arising from bacterial colonization of the human gut have yielded a wide variety of metabolic, structural, protective and other beneficial functions. The enhanced metabolic activities of the colonized gut ensure that otherwise indigestible dietary components are degraded with release of by-products providing an important nutrient source for the host. Similarly, the immunological importance of the gut microbiota is well-recognized and is exemplified in germ-free animals which have an impaired immune system that is functionally reconstituted following the introduction of commensal bacteria [3-5].

Dramatic changes in microbiota composition have been documented in gastrointestinal disorders such as inflammatory bowel disease (IBD). For example, the levels of *Clostridium* cluster XIVa bacteria are reduced in IBD patients whilst numbers of *E. coli* are increased, suggesting a shift in the balance of symbionts and pathobionts within the gut [6-9]. Interestingly, this microbial dysbiosis is also associated with imbalances in T effector cell populations.

In recognition of the potential positive effect that certain bacterial strains may have on the animal gut, various strains have been proposed for use in the treatment of various diseases (see, for example, [10-13]). Also, certain strains, including mostly *Lactobacillus* and *Bifidobacterium* strains, have been proposed for use in treating various inflammatory and autoimmune diseases that are not directly linked to the intestines (see [14] and [15] for reviews). However, the relationship between different diseases and different bacterial strains, and the precise effects of particular bacterial strains on the gut and at a systemic level and on any particular types of diseases, are poorly characterised.

There is a requirement in the art for new methods of treating inflammatory and autoimmune diseases. There is also a requirement for the potential effects of gut bacteria to be characterised so that new therapies using gut bacteria can be developed.

SUMMARY OF THE INVENTION

The inventors have developed new therapies for treating and preventing inflammatory and autoimmune diseases. In particular, the inventors have developed new therapies for treating and preventing diseases and conditions mediated by IL-17 or the Th17 pathway. In particular, the inventors have identified that bacterial strains from the genus *Blautia* can be effective for reducing the Th17 inflammatory response. As described in the examples, oral administration of compositions comprising *Blautia stercoris* may reduce the severity of the inflammatory response, including the Th17 inflammatory response, in mouse models of asthma, rheumatoid arthritis and multiple sclerosis. Also, as described in the examples, oral administration of compositions comprising *Blautia wexlerae* may reduce the severity of the inflammatory response, including the Th17 inflammatory response, in mouse models of uveitis. Therefore, the inventors have identified that two different strains from different species in the genus *Blautia* may be effective for treating inflammatory and autoimmune diseases.

Therefore, in a first embodiment, the invention provides a composition comprising a bacterial strain of the genus *Blautia*, for use in a method of treating or preventing a disease or condition mediated by IL-17 or the Th17 pathway. The inventors have identified that treatment with bacterial strains from this genus can reduce levels of cytokines that are part of the Th17 pathway, including IL-17, can alleviate the Th17 inflammatory response and can provide clinical benefits in mouse models of inflammatory and autoimmune diseases mediated by IL-17 and the Th17 pathway.

In particular embodiments, the invention provides a composition comprising a bacterial strain of the genus *Blautia*, for use in a method of treating or preventing a disease or condition selected from the group consisting of: multiple sclerosis; arthritis, such as rheumatoid arthritis, osteoarthritis, psoriatic arthritis, or juvenile idiopathic arthritis; neuromyelitis optica (Devic's disease); ankylosing spondylitis; spondyloarthritis; psoriasis; systemic lupus erythematosus; inflammatory bowel disease, such as Crohn's disease or ulcerative colitis; celiac disease; asthma, such as allergic asthma or neutrophilic asthma; chronic obstructive pulmonary disease (COPD); cancer, such as breast cancer, colon cancer, lung cancer or ovarian cancer; uveitis; scleritis; vasculitis; Behcet's disease; atherosclerosis; atopic dermatitis; emphysema; periodontitis; allergic rhinitis; and allograft rejection. The effect shown for the bacterial strains from the genus *Blautia* on the Th17 inflammatory response may provide therapeutic benefits for diseases and conditions mediated by IL-17 and the Th17 pathway, such as those listed above.

In preferred embodiments, the invention provides a composition comprising a bacterial strain of the genus *Blautia*, for use in a method of treating or preventing asthma, such as neutrophilic asthma or allergic asthma. The inventors have identified that treatment with *Blautia* strains can reduce recruitment of neutrophils and eosinophils into the lungs, which can help treat or prevent asthma. Furthermore, the inventors have tested and demonstrated the efficacy of *Blautia* strains in mouse models of asthma. In certain embodiments, the composition is for use in a method of treating or preventing neutrophilic asthma or eosinophilic asthma. The effect shown for the compositions of the invention on neutrophils and eosinophils mean that they may be particularly effective for treating or preventing neutrophilic asthma and eosinophilic asthma. Indeed, in certain embodiments, the composition is for use in a method of reducing a neutrophilic inflammatory response in the treatment or prevention of asthma, or the composition is for use in a method of reducing an eosinophilic inflammatory response in the treatment or prevention of asthma. In preferred embodiments, the invention provides a composition comprising a bacterial strain of the species *Blautia stercoris* for use in the treatment of asthma, and in particular eosinophilic or allergic asthma. Also, *Blautia stercoris* is shown to have a particularly pronounced effect on neutrophils in asthma models and treatment with *Blautia stercoris* may be particularly effective for treating neutrophilic asthma. In certain embodiments, the invention provides a composition comprising a bacterial strain of the species *Blautia wexlerae* for use in the treatment of asthma, and in particular eosinophilic or allergic asthma.

In further preferred embodiments, the invention provides a composition comprising a bacterial strain of the genus *Blautia*, for use in a method of treating or preventing rheumatoid arthritis. The inventors have identified that treatment with *Blautia* strains can provide clinical benefits in a mouse model of rheumatoid arthritis and can reduce joint swelling. In preferred embodiments, the invention provides a composition comprising a bacterial strain of the species *Blautia stercoris*, for use in the treatment of rheumatoid arthritis. Compositions using *Blautia stercoris* may be particularly effective for treating rheumatoid arthritis. In certain embodiments, the invention provides a composition comprising a bacterial strain of the species *Blautia wexlerae*, for use in the treatment of rheumatoid arthritis.

In further preferred embodiments, the invention provides a composition comprising a bacterial strain of the genus *Blautia*, for use in a method of treating or preventing multiple sclerosis. The inventors have identified that treatment with *Blautia* strains can reduce disease incidence and disease severity in a mouse model of multiple sclerosis. In preferred embodiments, the invention provides a composition comprising a bacterial strain of the species *Blautia stercoris*, for use in the treatment of multiple sclerosis. Compositions using *Blautia stercoris* may be particularly effective for treating multiple sclerosis. In certain embodiments, the invention provides a composition comprising a bacterial strain of the species *Blautia wexlerae*, for use in the treatment of multiple sclerosis.

In further preferred embodiments, the invention provides a composition comprising a bacterial strain of the genus *Blautia*, for use in a method of treating or preventing uveitis, such as posterior uveitis. The inventors have identified that treatment with *Blautia* strains can reduce disease incidence and disease severity in a mouse model of uveitis and can prevent or reduce retinal damage. In preferred embodiments, the invention provides a composition comprising a bacterial strain of the species *Blautia wexlerae*, for use in the treatment of uveitis. Compositions using *Blautia wexlerae* may be particularly effective for treating uveitis. In certain embodiments, the invention provides a composition comprising a bacterial strain of the species *Blautia stercoris*, for use in the treatment of uveitis.

In further preferred embodiments, the invention provides a composition comprising a bacterial strain of the genus *Blautia*, for use in a method of treating or preventing cancer, such as breast, lung or liver cancer. Compositions comprising a bacterial strain of the genus *Blautia* may reduce tumour growth in mouse models of breast, lung and liver cancer. In certain embodiments, the composition is for use in a method of reducing tumour size or preventing tumour growth in the treatment of cancer. In certain embodiments, the invention provides a composition comprising a bacterial strain of the species *Blautia stercoris*, for use in the treatment of cancer. In certain embodiments, the invention provides a composition comprising a bacterial strain of the species *Blautia wexlerae*, for use in the treatment of cancer.

In certain embodiments, the compositions of the invention are for use in a method of reducing IL-17 production or reducing Th17 cell differentiation in the treatment or prevention of a disease or condition mediated by IL-17 or the Th17 pathway. In particular, the compositions of the invention may be used in reducing IL-17 production or reducing Th17 cell differentiation in the treatment or prevention of asthma, rheumatoid arthritis or multiple sclerosis, or of asthma, rheumatoid arthritis, multiple sclerosis, uveitis or cancer. Preferably, the invention provides compositions comprising a bacterial strain of the species *Blautia stercoris*, for use in reducing IL-17 production or reducing Th17 cell differentiation in the treatment or prevention of asthma, rheumatoid arthritis or multiple sclerosis. The invention also provides compositions comprising a bacterial strain of the species *Blautia stercoris*, for use in reducing IL-17 production or reducing Th17 cell differentiation in the treatment or prevention of uveitis. The invention also provides compositions comprising a bacterial strain of the species *Blautia wexlerae*, for use in reducing IL-17 production or reducing Th17 cell differentiation in the treatment or prevention of asthma, rheumatoid arthritis or multiple sclerosis or uveitis.

In certain embodiments, the composition is for use in a patient with elevated IL-17 levels or Th17 cells. The effect on the Th17 inflammatory response shown for *Blautia* strains may be particularly beneficial for such patients.

In preferred embodiments of the invention, the bacterial strain in the composition is of *Blautia stercoris*. Closely related strains may also be used, such as bacterial strains that have a 16s rRNA sequence that is at least 95%, 96%, 97%, 98%, 99%, 99.5% or 99.9% identical to the 16s rRNA sequence of a bacterial strain of *Blautia stercoris*. Preferably, the bacterial strain has a 16s rRNA sequence that is at least 95%, 96%, 97%, 98%, 99%, 99.5% or 99.9% identical to SEQ ID NO:1 or 2. Preferably, the sequence identity is to SEQ ID NO:2. Preferably, the bacterial strain for use in the invention has the 16s rRNA sequence represented by SEQ ID NO:2.

In preferred embodiments of the invention, the bacterial strain in the composition is of *Blautia wexlerae*. Closely related strains may also be used, such as bacterial strains that have a 16s rRNA sequence that is at least 95%, 96%, 97%, 98%, 99%, 99.5% or 99.9% identical to the 16s rRNA sequence of a bacterial strain of *Blautia wexlerae*. Preferably, the bacterial strain has a 16s rRNA sequence that is at least 95%, 96%, 97%, 98%, 99%, 99.5% or 99.9% identical to SEQ ID NO:3 or 4. Preferably, the sequence identity is to SEQ ID NO:4. Preferably, the bacterial strain for use in the invention has the 16s rRNA sequence represented by SEQ ID NO:4.

In certain embodiments, the composition of the invention is for oral administration. Oral administration of the strains of the invention can be effective for treating IL-17- or Th17 pathway-mediated diseases and conditions. Also, oral administration is convenient for patients and practitioners and allows delivery to and/or partial or total colonisation of the intestine.

In certain embodiments, the composition of the invention comprises one or more pharmaceutically acceptable excipients or carriers.

In certain embodiments, the composition of the invention comprises a bacterial strain that has been lyophilised. Lyophilisation is an effective and convenient technique for preparing stable compositions that allow delivery of bacteria.

In certain embodiments, the invention provides a food product comprising the composition as described above.

In certain embodiments, the invention provides a vaccine composition comprising the composition as described above.

Additionally, the invention provides a method of treating or preventing a disease or condition mediated by IL-17 or the Th17 pathway, comprising administering a composition comprising a bacterial strain of the genus *Blautia*.

In developing the above invention, the inventors have identified and characterised a bacterial strain that is particularly useful for therapy. The *Blautia stercoris* strain of the invention is shown to be effective for treating the diseases described herein, such as arthritis, asthma and multiple sclerosis. Therefore, in another aspect, the invention provides a cell of the *Blautia stercoris* strain deposited under accession number NCIMB 42381, or a derivative thereof. The invention also provides compositions comprising such cells, or biologically pure cultures of such cells. The invention also provides a cell of the *Blautia stercoris* strain deposited under accession number NCIMB 42381, or a derivative thereof, for use in therapy, in particular for the diseases described herein.

In developing the above invention, the inventors have identified and characterised a further bacterial strain that is particularly useful for therapy. The *Blautia wexlerae* strain of the invention is shown to be effective for treating the diseases described herein, such as uveitis. Therefore, in another aspect, the invention provides a cell of the *Blautia wexlerae* strain deposited under accession number NCIMB 42486, or a derivative thereof. The invention also provides compositions comprising such cells, or biologically pure cultures of such cells. The invention also provides a cell of the *Blautia wexlerae* strain deposited under accession number NCIMB 42486, or a derivative thereof, for use in therapy, in particular for the diseases described herein.

BRIEF DESCRIPTION OF DRAWINGS

FIG. 64: Mouse model of rheumatoid arthritis—Visual Template for Histopathology Scoring. Representative images showing composite scores from mouse tarsal joints in a collagen-induced arthritis study.

FIG. 69: Mouse model of rheumatoid arthritis—Histopathology: Representative Pictures. Animal ID (#n.n) and limb (R for right, L for left) are indicated between brackets. Left image (vehicle): extensive joint and bone destruction with inflammation and fibrosis extending to the peri-articular soft tissues.

DISCLOSURE OF THE INVENTION

Bacterial Strains

Figure 1:
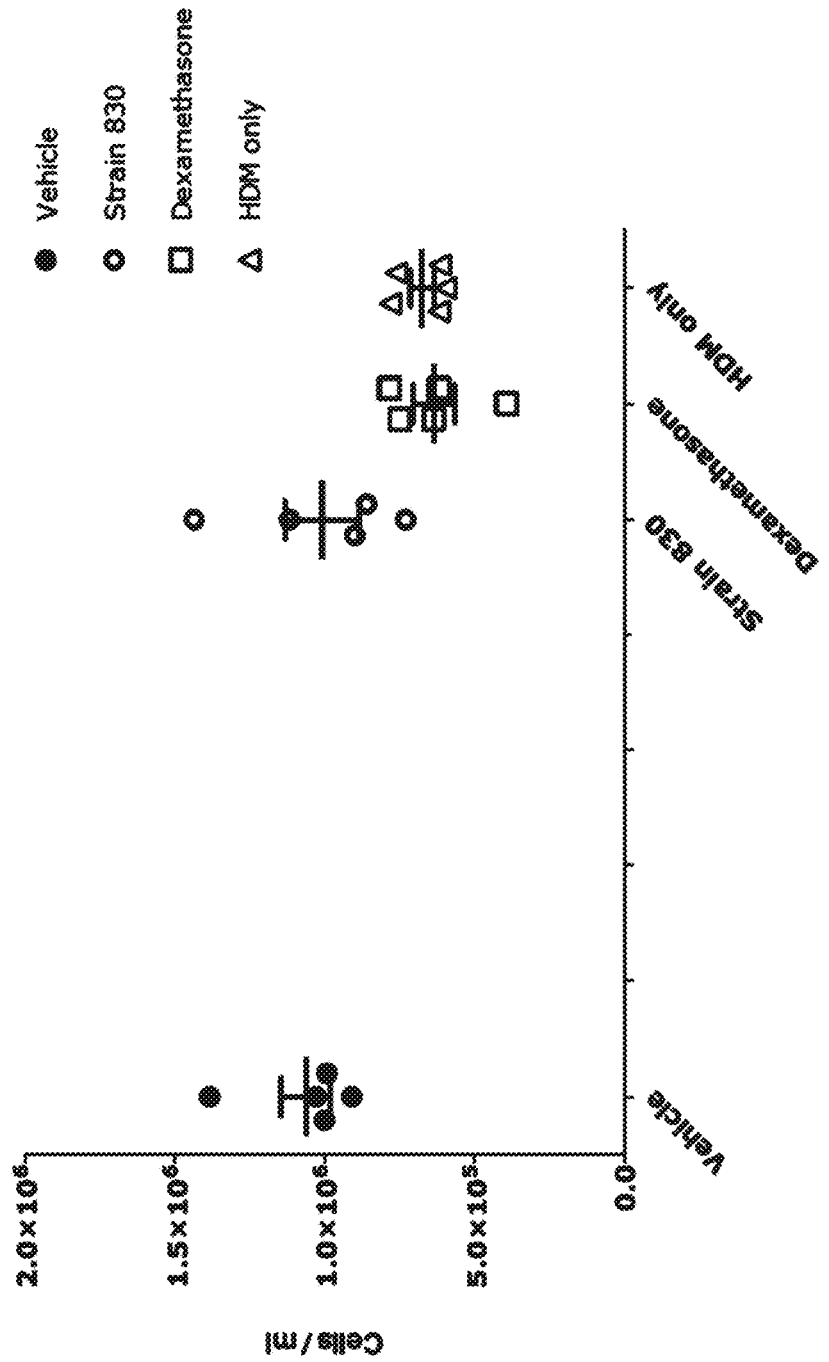
FIG. 1: Mouse model of house dust mite-induced asthma—Total BAL fluid cell counts.
Figure 2:
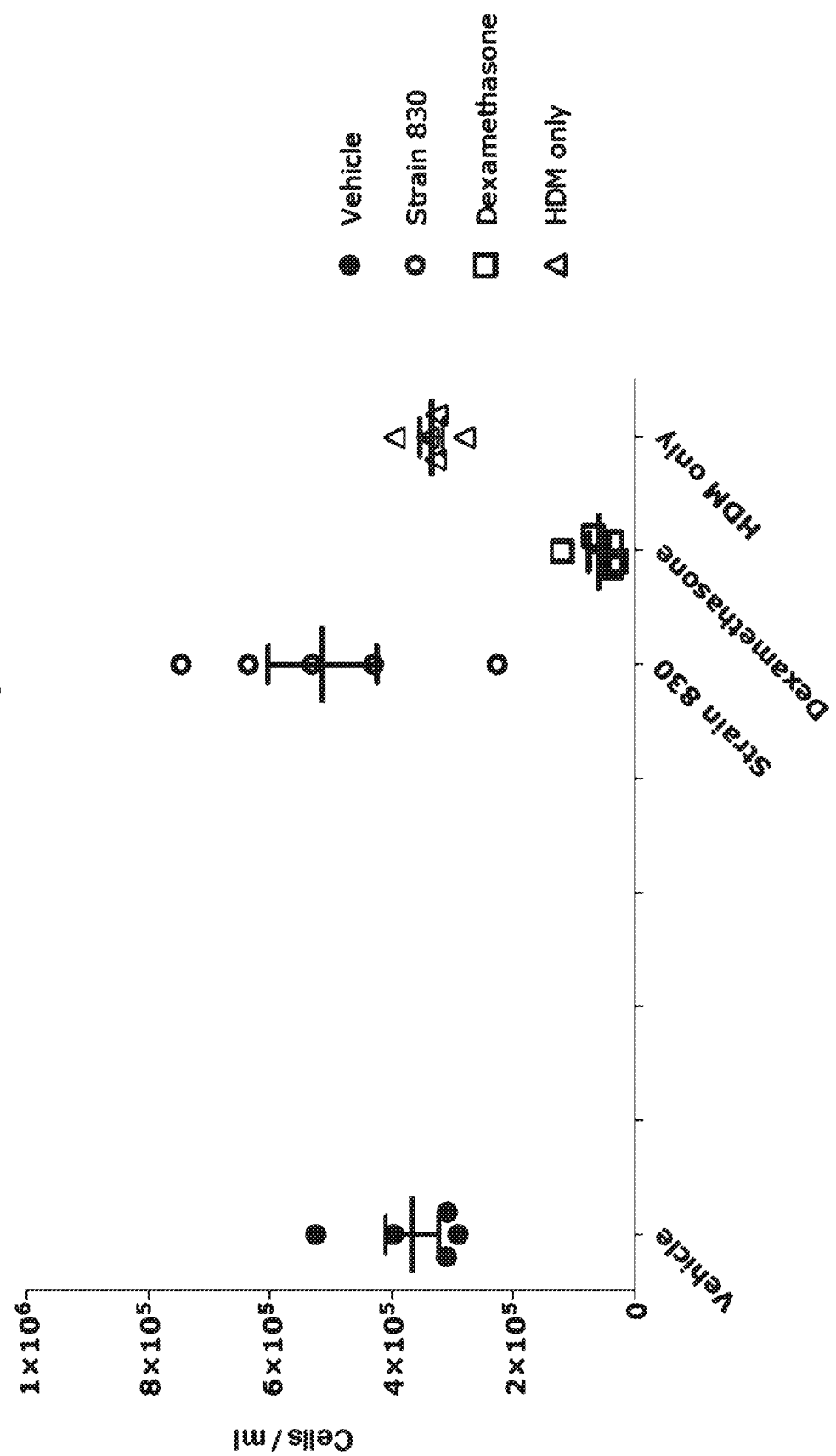
FIG. 2: Mouse model of house dust mite-induced asthma—Total eosinophil count in BALF.
Figure 3:
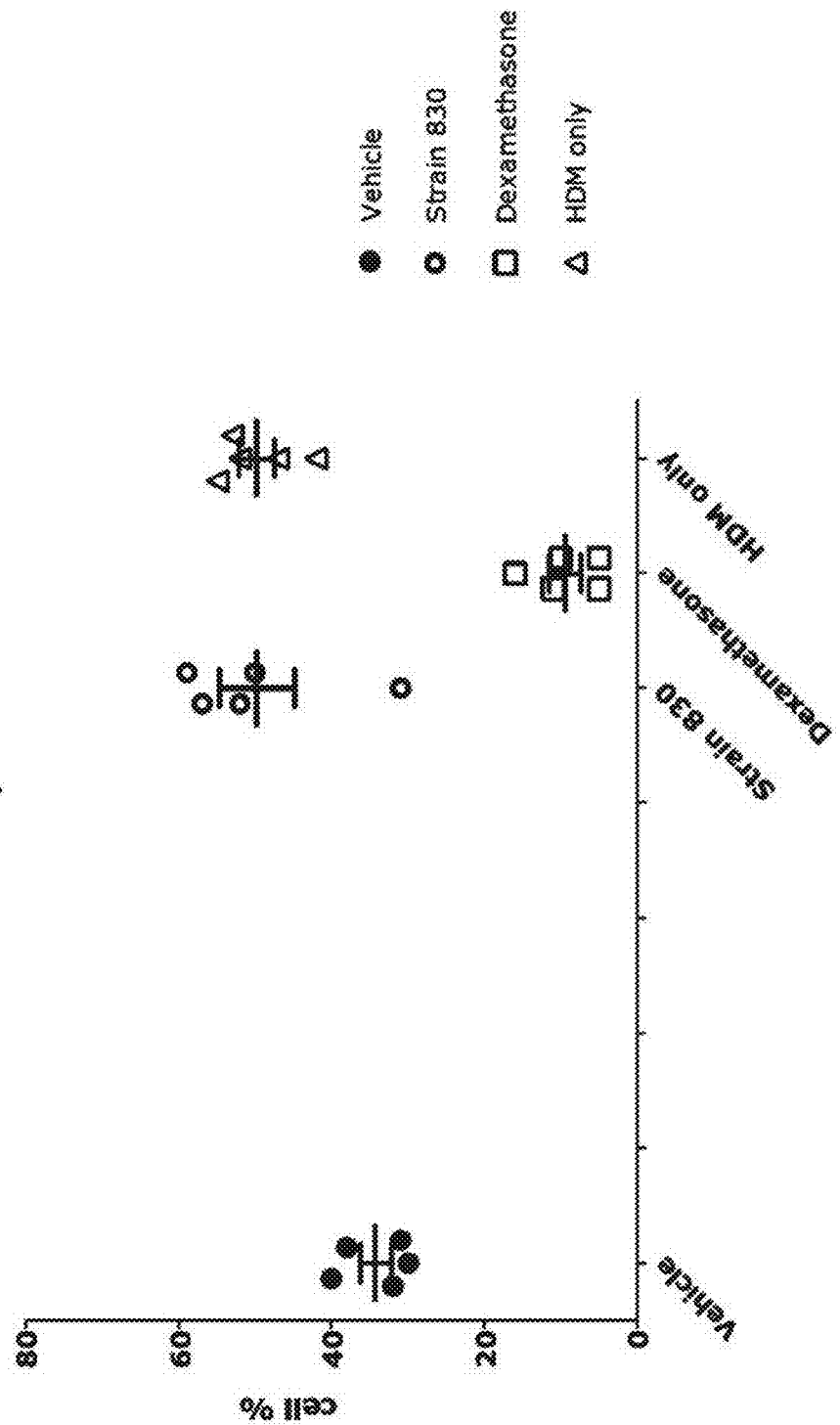
FIG. 3: Mouse model of house dust mite-induced asthma—Proportion of eosinophils in BALF.
Figure 4:
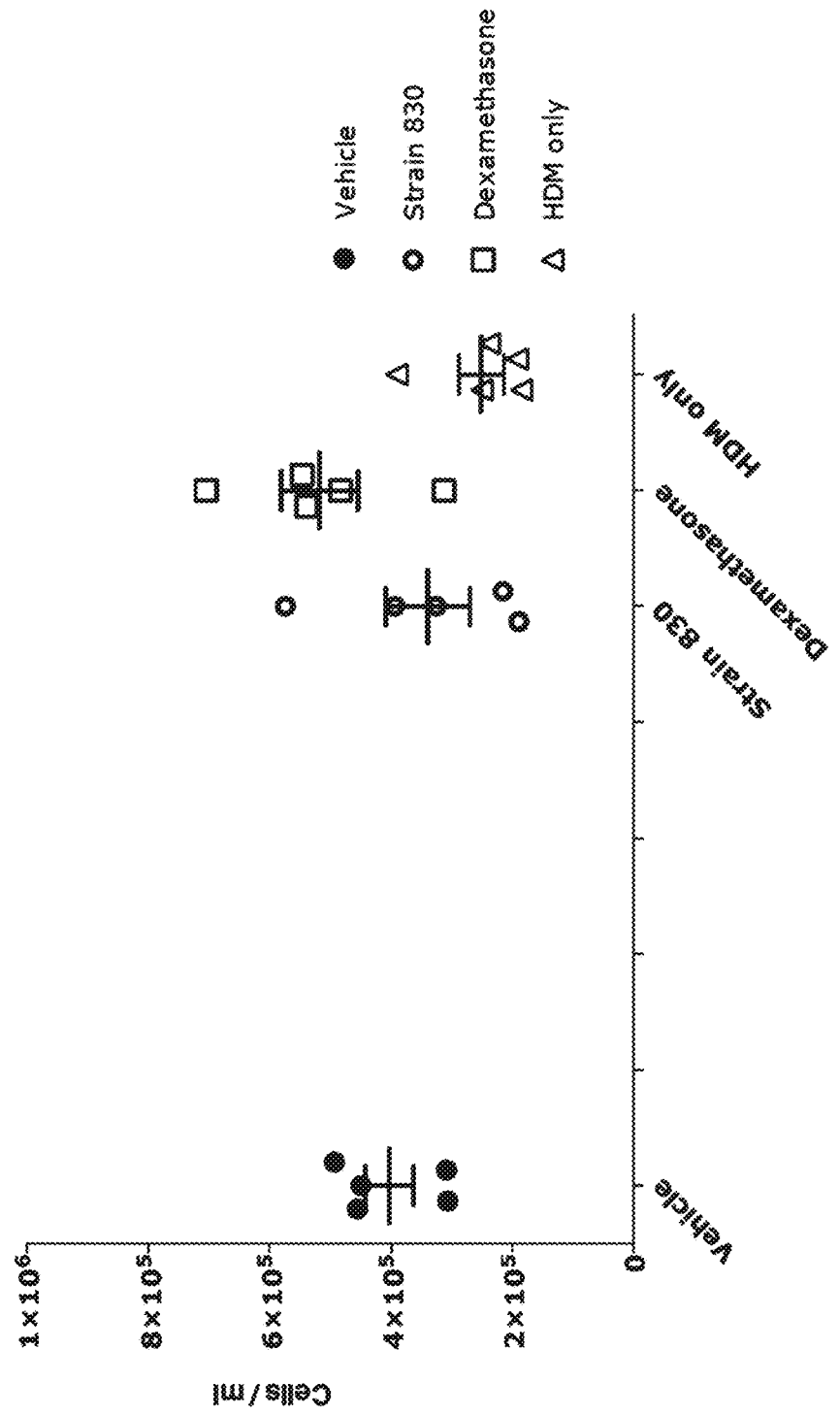
FIG. 4: Mouse model of house dust mite-induced asthma—Total macrophage count in BALF.
Figure 5:
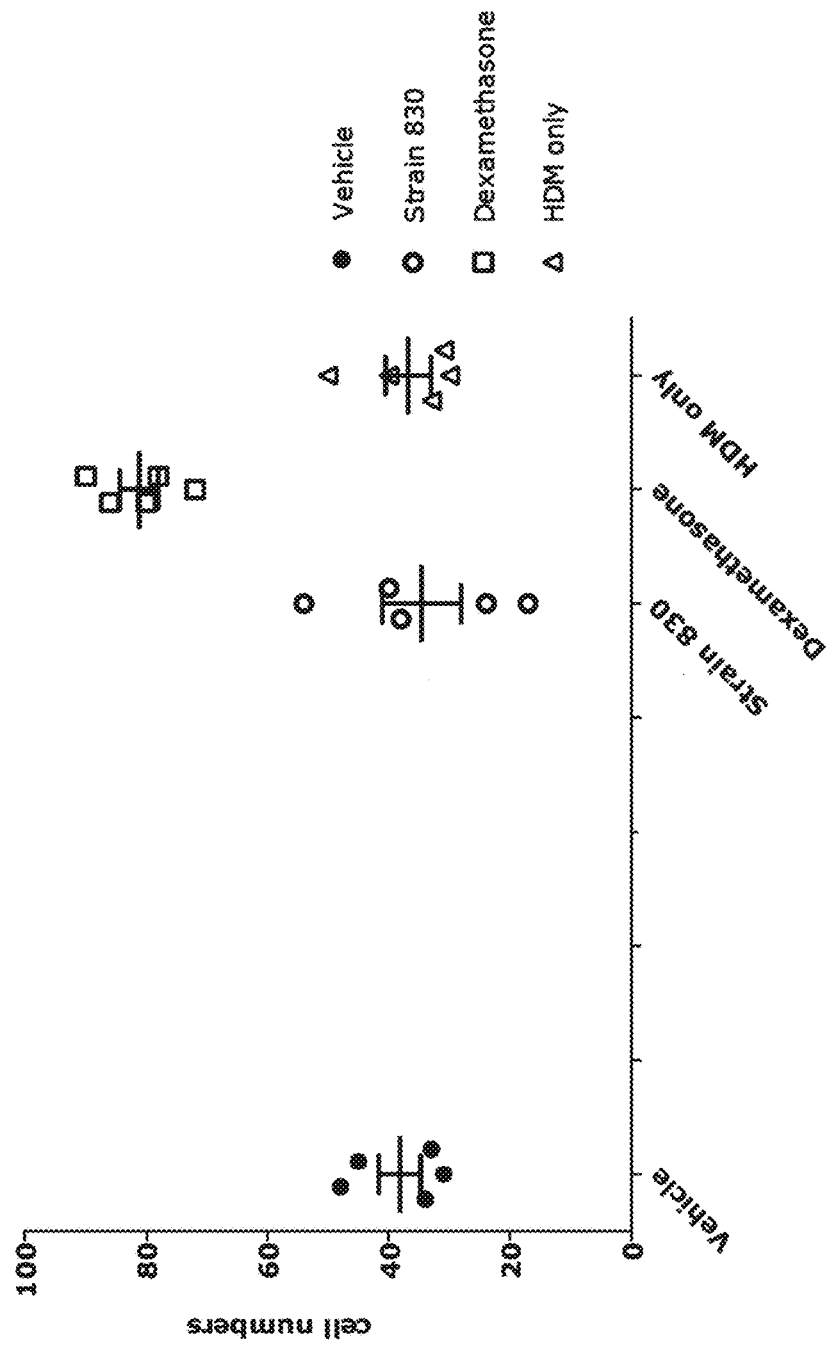
FIG. 5: Mouse model of house dust mite-induced asthma—Proportion of macrophages in BALF.

The compositions of the invention comprise a bacterial strain of the genus *Blautia*. The examples demonstrate that bacteria of this genus are useful for treating or preventing diseases and conditions mediated by IL-17 or the Th17 pathway. The preferred bacterial strains are of the species *Blautia*.

Examples of *Blautia* strains for use in the invention include *Blautia stercoris*, *B. faecis*, *B. coccoides*, *B. glucerasea*, *B. hansenii*, *B. hydrogenotrophica*, *B. luti*, *B. producta*, *B. schinkii* and *B. wexlerae*.

The *Blautia* species are Gram-reaction-positive, non-motile bacteria that may be either coccoid or oval and all are obligate anaerobes that produce acetic acid as the major end product of glucose fermentation [16]. *Blautia* may be isolated from the human gut, although *B. producta* was isolated from a *septicaemia* sample. The GenBank accession number for the 16S rRNA gene sequence of *Blautia stercoris* strain GAM6-1$^T$ is HM626177 (disclosed herein as SEQ ID NO:1). An exemplary *Blautia stercoris* strain is described in [17]. The type strain of *Blautia wexlerae* is WAL 14507=ATCC BAA-1564=DSM 19850 [18]. The GenBank accession number for the 16S rRNA gene sequence of *Blautia wexlerae* strain WAL 14507 T is EF036467 (disclosed herein as SEQ ID NO:3). This exemplary *Blautia wexlerae* strain is described in [18].

The *Blautia stercoris* bacterium deposited under accession number NCIMB 42381 was tested in the Examples and is also referred to herein as strain 830. A 16S rRNA sequence for the 830 strain that was tested is provided in SEQ ID NO:2. Strain 830 was deposited with the international depositary authority NCIMB, Ltd. (Ferguson Building, Aberdeen, AB21 9YA, Scotland) by GT Biologics Ltd. (Life Sciences Innovation Building, Aberdeen, AB25 2ZS, Scotland) on 12 Mar. 2015 as "*Blautia stercoris* 830" and was assigned accession number NCIMB 42381. GT Biologics Ltd. subsequently changed its name to 4D Pharma Research Limited.

The genome of strain 830 comprises a chromosome and plasmid. A chromosome sequence for strain 830 is provided in SEQ ID NO:5. A plasmid sequence for strain 830 is provided in SEQ ID NO:6. These sequences were generated using the PacBio RS II platform.

The *Blautia wexlerae* bacterium deposited under accession number NCIMB 42486 was tested in the Examples and is also referred to herein as strain MRX008. A 16S rRNA sequence for the MRX008 strain that was tested is provided in SEQ ID NO:4. Strain MRX008 was deposited with the international depositary authority NCIMB, Ltd. (Ferguson Building, Aberdeen, AB21 9YA, Scotland) by 4D Pharma Research Ltd. (Life Sciences Innovation Building, Aberdeen, AB25 2ZS, Scotland) on 16 Nov. 2015 as "*Blautia/Ruminococcus*" and was assigned accession number NCIMB 42486.

The NCIMB 42381 and NCIMB 42382 deposits were made under the terms of the Budapest Treaty. Maintenance of a viable culture is assured for 30 years from the date of the deposits. All restrictions on the availability to the public of the deposited microorganisms will be irrevocably removed upon the granting of a patent for this application.

Bacterial strains closely related to the strains tested in the examples are also expected to be effective for treating or preventing diseases and conditions mediated by IL-17 or the Th17 pathway. In certain embodiments, the bacterial strain for use in the invention has a 16s rRNA sequence that is at least 95%, 96%, 97%, 98%, 99%, 99.5% or 99.9% identical to the 16s rRNA sequence of a bacterial strain of *Blautia stercoris*. Preferably, the bacterial strain for use in the invention has a 16s rRNA sequence that is at least 95%, 96%, 97%, 98%, 99%, 99.5% or 99.9% identical to SEQ ID NO:1 or 2. Preferably, the sequence identity is to SEQ ID NO:2. Preferably, the bacterial strain for use in the invention has the 16s rRNA sequence represented by SEQ ID NO:2. In certain embodiments, the bacterial strain for use in the invention has a 16s rRNA sequence that is at least 95%, 96%, 97%, 98%, 99%, 99.5% or 99.9% identical to the 16s rRNA sequence of a bacterial strain of *Blautia wexlerae*. Preferably, the bacterial strain for use in the invention has a 16s rRNA sequence that is at least 95%, 96%, 97%, 98%, 99%, 99.5% or 99.9% identical to SEQ ID NO:3 or 4. Preferably, the sequence identity is to SEQ ID NO:4. Preferably, the bacterial strain for use in the invention has the 16s rRNA sequence represented by SEQ ID NO:4.

In certain embodiments, the bacterial strain for use in the invention has a chromosome with sequence identity to SEQ ID NO:5. In preferred embodiments, the bacterial strain for use in the invention has a chromosome with at least 90% sequence identity (e.g. at least 92%, 94%, 95%, 96%, 97%, 98%, 99% or 100% sequence identity) to SEQ ID NO:5 across at least 60% (e.g. at least 65%, 70%, 75%, 80%, 85%, 95%, 96%, 97%, 98%, 99% or 100%) of SEQ ID NO:5. For example, the bacterial strain for use in the invention may have a chromosome with at least 90% sequence identity to SEQ ID NO: 5 across 70% of SEQ ID NO:5, or at least 90% sequence identity to SEQ ID NO:5 across 80% of SEQ ID NO:5, or at least 90% sequence identity to SEQ ID NO:5 across 90% of SEQ ID NO:5, or at least 90% sequence identity to SEQ ID NO:5 across 100% of SEQ ID NO:5, or at least 95% sequence identity to SEQ ID NO:5 across 70% of SEQ ID NO:5, or at least 95% sequence identity to SEQ ID NO:5 across 80% of SEQ ID NO:5, or at least 95% sequence identity to SEQ ID NO:5 across 90% of SEQ ID NO:5, or at least 95% sequence identity to SEQ ID NO:5 across 100% of SEQ ID NO:5, or at least 98% sequence identity to SEQ ID NO:5 across 70% of SEQ ID NO:5, or at least 98% sequence identity to SEQ ID NO:5 across 80% of SEQ ID NO:5, or at least 98% sequence identity to SEQ ID NO:5 across 90% of SEQ ID NO:5, or at least 98% sequence identity to SEQ ID NO:5 across 100% of SEQ ID NO:5.

In certain embodiments, the bacterial strain for use in the invention has a plasmid with sequence identity to SEQ ID NO:6. In preferred embodiments, the bacterial strain for use in the invention has a plasmid with at least 90% sequence identity (e.g. at least 92%, 94%, 95%, 96%, 97%, 98%, 99% or 100% sequence identity) to SEQ ID NO:6 across at least 60% (e.g. at least 65%, 70%, 75%, 80%, 85%, 95%, 96%, 97%, 98%, 99% or 100%) of SEQ ID NO:6. For example, the bacterial strain for use in the invention may have a plasmid with at least 90% sequence identity to SEQ ID NO:6 across 70% of SEQ ID NO:6, or at least 90% sequence identity to SEQ ID NO:6 across 80% of SEQ ID NO:6, or at least 90% sequence identity to SEQ ID NO:6 across 90% of SEQ ID NO:6, or at least 90% sequence identity to SEQ ID NO:6 across 100% of SEQ ID NO:6, or at least 95% sequence identity to SEQ ID NO:6 across 70% of SEQ ID NO:6, or at least 95% sequence identity to SEQ ID NO:6 across 80% of SEQ ID NO:6, or at least 95% sequence identity to SEQ ID NO:6 across 90% of SEQ ID NO:6, or at least 95% sequence identity to SEQ ID NO:6 across 100% of SEQ ID NO:6, or at least 98% sequence identity to SEQ ID NO:6 across 70% of SEQ ID NO:6, or at least 98% sequence identity to SEQ ID NO:6 across 80% of SEQ ID NO:6, or at least 98% sequence identity to SEQ ID NO:6 across 90% of SEQ ID NO:6, or at least 98% sequence identity to SEQ ID NO:6 across 100% of SEQ ID NO:6.

In certain embodiments, the bacterial strain for use in the invention has a chromosome with sequence identity to SEQ ID NO:5 and a plasmid with sequence identity to SEQ ID NO:6.

Bacterial strains that are biotypes of the bacterium deposited under accession number 42381 are also expected to be effective for treating or preventing diseases and conditions mediated by IL-17 or the Th17 pathway. Bacterial strains that are biotypes of the bacterium deposited under accession number 42486 are also expected to be effective for treating or preventing diseases and conditions mediated by IL-17 or the Th17 pathway. A biotype is a closely related strain that has the same or very similar physiological and biochemical characteristics.

Strains that are biotypes of a bacterium deposited under accession number NCIMB 42381 or 42486 and that are suitable for use in the invention may be identified by sequencing other nucleotide sequences for a bacterium deposited under accession number NCIMB 42381 or 42486. For example, substantially the whole genome may be sequenced and a biotype strain for use in the invention may have at least 95%, 96%, 97%, 98%, 99%, 99.5% or 99.9% sequence identity across at least 80% of its whole genome (e.g. across at least 85%, 90%, 95% or 99%, or across its whole genome). Other suitable sequences for use in identifying biotype strains may include hsp60 or repetitive sequences such as BOX, ERIC, $(GTG)_5$, or REP or [19]. Biotype strains may have sequences with at least 95%, 96%, 97%, 98%, 99%, 99.5% or 99.9% sequence identity to the corresponding sequence of a bacterium deposited under accession number NCIMB 42381 or 42486.

Alternatively, strains that are biotypes of a bacterium deposited under accession number NCIMB 42381 or 42486 and that are suitable for use in the invention may be identified by using the accession number NCIMB 42381 deposit or the accession number NCIMB 42486 deposit, and restriction fragment analysis and/or PCR analysis, for example by using fluorescent amplified fragment length polymorphism (FAFLP) and repetitive DNA element (rep)-PCR fingerprinting, or protein profiling, or partial 16S or 23s rDNA sequencing. In preferred embodiments, such techniques may be used to identify other Blautia stercoris or Blautia wexlerae strains.

In certain embodiments, strains that are biotypes of a bacterium deposited under accession number NCIMB 42381 or 42486 and that are suitable for use in the invention are strains that provide the same pattern as a bacterium deposited under accession number NCIMB 42381 or 42486 when analysed by amplified ribosomal DNA restriction analysis (ARDRA), for example when using Sau3AI restriction enzyme (for exemplary methods and guidance see, for example, [20]). Alternatively, biotype strains are identified as strains that have the same carbohydrate fermentation patterns as a bacterium deposited under accession number NCIMB 42381 or 42486.

Other Blautia strains that are useful in the compositions and methods of the invention, such as biotypes of a bacterium deposited under accession number NCIMB 42381 or 42486, may be identified using any appropriate method or strategy, including the assays described in the examples. For instance, strains for use in the invention may be identified by culturing in anaerobic YCFA and/or administering the bacteria to the type II collagen-induced arthritis mouse model and then assessing cytokine levels. In particular, bacterial strains that have similar growth patterns, metabolic type and/or surface antigens to a bacterium deposited under accession number NCIMB 42381 or 42486 may be useful in the invention. A useful strain will have comparable immune modulatory activity to the NCIMB 42381 or 42486 strain. In particular, a biotype strain will elicit comparable effects on the asthma, arthritis, multiple sclerosis and uveitis disease models and comparable effects on cytokine levels to the effects shown in the Examples, which may be identified by using the culturing and administration protocols described in the Examples.

A particularly preferred strain of the invention is the Blautia stercoris strain deposited under accession number NCIMB 42381. This is the exemplary 830 strain tested in the examples and shown to be effective for treating disease. Therefore, the invention provides a cell, such as an isolated cell, of the Blautia stercoris strain deposited under accession number NCIMB 42381, or a derivative thereof. The invention also provides a composition comprising a cell of the Blautia stercoris strain deposited under accession number NCIMB 42381, or a derivative thereof. The invention also provides a biologically pure culture of the Blautia stercoris strain deposited under accession number NCIMB 42381. The invention also provides a cell of the Blautia stercoris strain deposited under accession number NCIMB 42381, or a derivative thereof, for use in therapy, in particular for the diseases described herein.

A particularly preferred strain of the invention is the Blautia wexlerae strain deposited under accession number NCIMB 42486. This is the exemplary MRX008 strain tested in the examples and shown to be effective for treating disease. Therefore, the invention provides a cell, such as an isolated cell, of the Blautia wexlerae strain deposited under accession number NCIMB 42486, or a derivative thereof. The invention also provides a composition comprising a cell of the Blautia wexlerae strain deposited under accession number NCIMB 42486, or a derivative thereof. The invention also provides a biologically pure culture of the Blautia wexlerae strain deposited under accession number NCIMB 42486. The invention also provides a cell of the Blautia wexlerae strain deposited under accession number NCIMB 42486, or a derivative thereof, for use in therapy, in particular for the diseases described herein.

A derivative of the strain deposited under accession number NCIMB 42381 or 42486 may be a daughter strain (progeny) or a strain cultured (subcloned) from the original. A derivative of a strain of the invention may be modified, for example at the genetic level, without ablating the biological activity. In particular, a derivative strain of the invention is therapeutically active. A derivative strain will have comparable immune modulatory activity to the original NCIMB 42381 or 42486 strain. In particular, a derivative strain will elicit comparable effects on the asthma, arthritis, multiple sclerosis and uveitis disease models and comparable effects on cytokine levels to the effects shown in the Examples, which may be identified by using the culturing and administration protocols described in the Examples. A derivative of the NCIMB 42381 strain will generally be a biotype of the NCIMB 42381 strain. A derivative of the NCIMB 42486 strain will generally be a biotype of the NCIMB 42486 strain.

References to cells of the Blautia stercoris strain deposited under accession number NCIMB 42381 encompass any cells that have the same safety and therapeutic efficacy characteristics as the strains deposited under accession number NCIMB 42381, and such cells are encompassed by the invention. References to cells of the Blautia wexlerae strain deposited under accession number NCIMB 42486 encompass any cells that have the same safety and therapeutic efficacy characteristics as the strains deposited under accession number NCIMB 42486, and such cells are encompassed by the invention.

In preferred embodiments, the bacterial strains in the compositions of the invention are viable and capable of partially or totally colonising the intestine.

Therapeutic Uses

As demonstrated in the examples, the bacterial compositions of the invention are effective for reducing the Th17 inflammatory response. In particular, treatment with compositions of the invention achieves a reduction in IL-17A levels and other Th17 pathway cytokines, and clinical improvements in animal models of conditions mediated by IL-17 and the Th17 pathway. Therefore, the compositions of the invention may be useful for treating or preventing inflammatory and autoimmune diseases, and in particular diseases or conditions mediated by IL-17. In particular, the compositions of the invention may be useful for reducing or preventing elevation of the IL-17 inflammatory response.

Th17 cells are a subset of T helper cells that produce, for example, IL-17A, IL17-F, IL-21 and IL-22. Th17 cell differentiation and IL-17 expression may be driven by IL-23. These cytokines and others form important parts of the Th17 pathway, which is a well-established inflammatory signalling pathway that contributes to and underlies a number of inflammatory and autoimmune diseases (as described in, for example, [21-26]). Diseases wherein the Th17 pathway is activated are Th17 pathway-mediated diseases. Th17 pathway-mediated diseases can be ameliorated or alleviated by repressing the Th17 pathway, which may be through a reduction in the differentiation of Th17 cells or a reduction in their activity or a reduction in the level of Th17 pathway cytokines. Diseases mediated by the Th17 pathway may be characterised by increased levels of cytokines produced by Th17 cells, such as IL-17A, IL-17F, IL-21, IL-22, IL-26, IL-9 (reviewed in [27]). Diseases mediated by the Th17 pathway may be characterised by increased expression of Th-17-related genes, such as Stat3 or IL-23R. Diseases mediated by the Th17 pathway may be associated with increased levels of Th17 cells.

IL-17 is a pro-inflammatory cytokine that contributes to the pathogenesis of several inflammatory and autoimmune diseases and conditions. IL-17 as used herein may refer to any member of the IL-17 family, including IL-17A, IL-17B, IL-17C, IL-17D, IL-17E, and IL-17F. IL-17-mediated diseases and conditions are characterised by high expression of IL-17 and/or the accumulation or presence of IL-17-positive cells in a tissue affected by the disease or condition. Similarly, IL-17-mediated diseases and conditions are diseases and conditions that are exacerbated by high IL-17 levels or an increase in IL-17 levels, and that are alleviated by low IL-17 levels or a reduction in IL-17 levels. The IL-17 inflammatory response may be local or systemic.

Examples of diseases and conditions that may be mediated by IL-17 or the Th17 pathway include multiple sclerosis; arthritis, such as rheumatoid arthritis, osteoarthritis, psoriatic arthritis, or juvenile idiopathic arthritis; neuromyelitis optica (Devic's disease); ankylosing spondylitis; spondyloarthritis; psoriasis; systemic lupus erythematosus; inflammatory bowel disease, such as Crohn's disease or ulcerative colitis; celiac disease; asthma, such as allergic asthma or neutrophilic asthma; chronic obstructive pulmonary disease (COPD); cancer, such as breast cancer, colon cancer, lung cancer or ovarian cancer; uveitis; scleritis; vasculitis; Behcet's disease; atherosclerosis; atopic dermatitis; emphysema; periodontitis; allergic rhinitis; and allograft rejection. In preferred embodiments, the compositions of the invention are used for treating or preventing one or more of these conditions or diseases. In further preferred embodiments, these conditions or diseases are mediated by IL-17 or the Th17 pathway.

In certain embodiments, the compositions of the invention are for use in a method of reducing IL-17 production or reducing Th17 cell differentiation in the treatment or prevention of a disease or condition mediated by IL-17 or the Th17 pathway. In certain embodiments, the compositions of the invention are for use in treating or preventing an inflammatory or autoimmune disease, wherein said treatment or prevention is achieved by reducing or preventing elevation of the Th17 inflammatory response. In certain embodiments, the compositions of the invention are for use in treating a patient with an inflammatory or autoimmune disease, wherein the patient has elevated IL-17 levels or elevated Th17 cells or is exhibiting a Th17 inflammatory response. In certain embodiments, the patient may have been diagnosed with a chronic inflammatory or autoimmune disease or condition, or the composition of the invention may be for use in preventing an inflammatory or autoimmune disease or condition developing into a chronic inflammatory or autoimmune disease or condition. In certain embodiments, the disease or condition may not be responsive to treatment with TNF-α inhibitors. These uses of the invention may be applied to any of the specific disease or conditions listed in the preceding paragraph.

IL-17 and the Th17 pathway are often associated with chronic inflammatory and autoimmune diseases, so the compositions of the invention may be particularly useful for treating or preventing chronic diseases or conditions as listed above. In certain embodiments, the compositions are for use in patients with chronic disease. In certain embodiments, the compositions are for use in preventing the development of chronic disease.

The compositions of the invention may be useful for treating diseases and conditions mediated by IL-17 or the Th17 pathway and for addressing the Th17 inflammatory response, so the compositions of the invention may be particularly useful for treating or preventing chronic disease, treating or preventing disease in patients that have not responded to other therapies (such as treatment with TNF-α inhibitors), and/or treating or preventing the tissue damage and symptoms associated with IL-17 and Th17 cells. For example, IL-17 is known to activate matrix destruction in cartilage and bone tissue and IL-17 has an inhibitory effect on matrix production in chondrocytes and osteoblasts, so the compositions of the invention may be useful for treating or preventing bone erosion or cartilage damage.

In certain embodiments, treatment with compositions of the invention provides a reduction or prevents an elevation in IL-17 levels, in particular IL-17A levels. In certain embodiments, treatment with compositions of the invention provides a reduction or prevents an elevation in TNFα, IFN-γ or IL-6 levels. Such reduction or prevention of elevated levels of these cytokines may be useful for treating or preventing inflammatory and autoimmune diseases and conditions, in particular those mediated by IL-17 or the Th17 pathway.

In certain embodiments, treatment with compositions of the invention provides a reduction or prevents an elevation in CD4+ cell levels. In certain embodiments, treatment with compositions of the invention provides a reduction or prevents an elevation in the level of dendritic cell maturation, in particular of CD1a+CD14− monocyte derived dendritic cells. Such a reduction or prevention of elevated levels of the CD4+ cell levels or the reduction or prevention of elevation in the level of dendritic cell maturation may be useful for treating or preventing inflammatory and autoimmune diseases and conditions, in particular those mediated by IL-17 or the Th17 pathway.

Asthma

In preferred embodiments, the compositions of the invention are for use in treating or preventing asthma. The examples demonstrate that the compositions of the invention achieve a reduction in the recruitment of neutrophils and/or eosinophils into the airways following sensitisation and challenge with house dust mite extract and so they may be useful in the treatment or prevention of asthma. Asthma is a chronic disease characterised by inflammation and restriction of the airways. The inflammation in asthma may be mediated by IL-17 and/or Th17 cells, and so the compositions of the invention may be particularly effective for preventing or treating asthma. The inflammation in asthma may be mediated by eosinophils and/or neutrophils.

In certain embodiments, the asthma is eosinophilic or allergic asthma. Eosinophilic and allergic asthma are characterised by increased numbers of eosinophils in peripheral blood and in airway secretions and is associated pathologically with thickening of the basement membrane zone and pharmacologically by corticosteroid responsiveness [28]. Compositions that reduce or inhibit eosinophil recruitment or activation may be useful for treating or preventing eosinophilic and allergic asthma.

In additional embodiments, the compositions of the invention are for use in treating or preventing neutrophilic asthma (or non-eosinophilic asthma). High neutrophil numbers are associated with severe asthma that may be insensitive to corticosteroid treatment. Compositions that reduce or inhibit neutrophil recruitment or activation may be useful for treating or preventing neutrophilic asthma.

Eosinophilic and neutrophilic asthma are not mutually exclusive conditions and treatments that help address either the eosinophil and neutrophil responses may be useful for treating asthma in general.

Increased IL-17 levels and activation of the Th17 pathway are associated with severe asthma, so the compositions of the invention may be useful for preventing the development of severe asthma or for treating severe asthma.

In certain embodiments, the compositions of the invention are for use in methods reducing an eosinophilic inflammatory response in the treatment or prevention of asthma, or for use in methods of reducing a neutrophilic inflammatory response in the treatment or prevention of asthma. As noted above, high levels of eosinophils in asthma is associated pathologically with thickening of the basement membrane zone, so reducing eosinophilic inflammatory response in the treatment or prevention of asthma may be able to specifically address this feature of the disease. Also, elevated neutrophils, either in combination with elevated eosinophils or in their absence, is associated with severe asthma and chronic airway narrowing. Therefore, reducing the neutrophilic inflammatory response may be particularly useful for addressing severe asthma.

In certain embodiments, the compositions reduce peribronchiolar infiltration in allergic asthma, or are for use in reducing peribronchiolar infiltration in the treatment of allergic asthma. In certain embodiments, the compositions reduce peribronchiolar and/or perivascular infiltration in neutrophilic asthma, or are for use in reducing peribronchiolar and/or perivascular infiltration in the treatment of allergic neutrophilic asthma.

In certain embodiments, treatment with compositions of the invention provides a reduction or prevents an elevation in TNFα levels.

In certain embodiments, the compositions of the invention are for use in a method of treating asthma that results in a reduction of the eosinophilic and/or neutrophilic inflammatory response. In certain embodiments, the patient to be treated has, or has previously been identified as having, elevated neutrophil or eosinophil levels, for example as identified through blood sampling or sputum analysis.

The compositions of the invention may be useful for preventing the development of asthma in a new-born when administered to the new-born, or to a pregnant woman. The compositions may be useful for preventing the development of asthma in children. The compositions of the invention may be useful for treating or preventing adult-onset asthma. The compositions of the invention may be useful for managing or alleviating asthma. The compositions of the invention may be particularly useful for reducing symptoms associated with asthma that is aggravated by allergens, such as house dust mites.

Treatment or prevention of asthma may refer to, for example, an alleviation of the severity of symptoms or a reduction in the frequency of exacerbations or the range of triggers that are a problem for the patient.

Arthritis

In preferred embodiments, the compositions of the invention are for use in treating or preventing rheumatoid arthritis (RA). The examples demonstrate that the compositions of the invention achieve a reduction in the clinical signs of RA in a mouse model, reduce cartilage and bone damage, and reduce the IL-17 inflammatory response, and so they may be useful in the treatment or prevention of RA. RA is a systemic inflammatory disorder that primarily affects joints. RA is associated with an inflammatory response that results in swelling of joints, synovial hyperplasia, and destruction of cartilage and bone. IL-17 and Th17 cells may have a key role in RA, for example because IL-17 inhibits matrix production in chondrocytes and osteoblasts and activates the production and function of matrix metalloproteinases and because RA disease activity is correlated to IL-17 levels and Th-17 cell numbers [29,30], so the compositions of the invention may be particularly effective for preventing or treating RA.

In certain embodiments, the compositions of the invention are for use in lowering IL-17 levels or preventing elevation of IL-17 levels in the treatment or prevention of RA. In certain embodiments, treatment with compositions of the invention provides a reduction or prevents an elevation in IL-17 levels, in particular IL-17A levels. In certain embodiments, treatment with compositions of the invention provides a reduction or prevents an elevation in IFN-γ or IL-6 levels.

In certain embodiments, treatment with the compositions of the invention results in a reduction in the swelling of joints. In certain embodiments, the compositions of the invention are for use in patients with swollen joints or patients identified as at risk of having swollen joints. In certain embodiments, the compositions of the invention are for use in a method of reducing joint swelling in RA.

In certain embodiments, treatment with the compositions of the invention results in a reduction in cartilage damage or bone damage. In certain embodiments, the compositions of the invention are for use in reducing or preventing cartilage or bone damage in the treatment of RA. In certain embodiments, the compositions are for use in treating patient with severe RA that are at risk of cartilage or bone damage.

Increased IL-17 levels and Th17 cell numbers are associated with cartilage and bone destruction in RA [29,30]. IL-17 is known to activate matrix destruction in cartilage and bone tissue and IL-17 has an inhibitory effect on matrix production in chondrocytes and osteoblasts. Therefore, in certain embodiments, the compositions of the invention are for use in preventing bone erosion or cartilage damage in the treatment of RA. In certain embodiments, the compositions are for use in treating patients that exhibit bone erosion or cartilage damage or patients identified as at risk of bone erosion or cartilage damage.

TNF-α is also associated with RA, but TNF-α is not involved in the pathogenesis of the later stages of the disease. In contrast, IL-17 has a role throughout all stages of chronic disease [31]. Therefore, in certain embodiments the compositions of the invention are for use in treating chronic RA or late-stage RA, such as disease that includes joint destruction and loss of cartilage. In certain embodiments, the compositions of the invention are for treating patients that have previously received anti-TNF-α therapy. In certain embodiments, the patients to be treated do not respond or no longer respond to anti-TNF-α therapy.

The compositions of the invention may be useful for modulating a patient's immune system, so in certain embodiments the compositions of the invention are for use in preventing RA in a patient that has been identified as at risk of RA, or that has been diagnosed with early-stage RA. The compositions of the invention may be useful for preventing the development of RA.

The compositions of the invention may be useful for managing or alleviating RA. The compositions of the invention may be particularly useful for reducing symptoms associated with joint swelling or bone destruction. Treatment or prevention of RA may refer to, for example, an alleviation of the severity of symptoms or a reduction in the frequency of exacerbations or the range of triggers that are a problem for the patient.

Multiple Sclerosis

In preferred embodiments, the compositions of the invention are for use in treating or preventing multiple sclerosis. The examples demonstrate that the compositions of the invention achieve a reduction in the disease incidence and disease severity in a mouse model of multiple sclerosis (the EAE model), and so they may be useful in the treatment or prevention of multiple sclerosis. Multiple sclerosis is an inflammatory disorder associated with damage to the myelin sheaths of neurons, particularly in the brain and spinal column. Multiple sclerosis is a chronic disease, which is progressively incapacitating and which evolves in episodes. IL-17 and Th17 cells may have a key role in multiple sclerosis, for example because IL-17 levels may correlate with multiple sclerosis lesions, IL-17 can disrupt blood brain barrier endothelial cell tight junctions, and Th17 cells can migrate into the central nervous system and cause neuronal loss [32,33]. Therefore, the compositions of the invention may be particularly effective for preventing or treating multiple sclerosis.

In certain embodiments, treatment with the compositions of the invention results in a reduction in disease incidence or disease severity. In certain embodiments, the compositions of the invention are for use in reducing disease incidence or disease severity. In certain embodiments, treatment with the compositions of the invention prevents a decline in motor function or results in improved motor function. In certain embodiments, the compositions of the invention are for use in preventing a decline in motor function or for use in improving motor function. In certain embodiments, treatment with the compositions of the invention prevents the development of paralysis. In certain embodiments, the compositions of the invention are for use in preventing paralysis in the treatment of multiple sclerosis.

The compositions of the invention may be useful for modulating a patient's immune system, so in certain embodiments the compositions of the invention are for use in preventing multiple sclerosis in a patient that has been identified as at risk of multiple sclerosis, or that has been diagnosed with early-stage multiple sclerosis or "relapsing-remitting" multiple sclerosis. The compositions of the invention may be useful for preventing the development of sclerosis. Indeed, the examples show that administration of compositions of the invention prevented the development of disease in many mice.

The compositions of the invention may be useful for managing or alleviating multiple sclerosis. The compositions of the invention may be particularly useful for reducing symptoms associated with multiple sclerosis. Treatment or prevention of multiple sclerosis may refer to, for example, an alleviation of the severity of symptoms or a reduction in the frequency of exacerbations or the range of triggers that are a problem for the patient.

Uveitis

In preferred embodiments, the compositions of the invention are for use in treating or preventing uveitis. The examples demonstrate that the compositions of the invention achieve a reduction in disease incidence and disease severity in an animal model of uveitis and so they may be useful in the treatment or prevention of uveitis. Uveitis is inflammation of the uvea and can result in retinal tissue destruction. It can present in different anatomical forms (anterior, intermediate, posterior or diffuse) and result from different, but related, causes, including systemic autoimmune disorders. IL-17 and the Th17 pathway are centrally involved in uveitis, so the compositions of the invention may be particularly effective for preventing or treating uveitis. References [34-41] describe elevated serum levels of interleukin-17A in uveitis patients, specific association of IL17A genetic variants with panuveitis, the role of Th17-associated cytokines in the pathogenesis of experimental autoimmune uveitis, the imbalance between Th17 Cells and regulatory T Cells during monophasic experimental autoimmune uveitis, the up-regulation of IL-17A in patients with uveitis and active Adamantiades-Behcet and Vogt-Koyanagi-Harada (VKH) diseases, the treatment of non-infectious uveitis with secukinumab (anti-IL-17A antibody), and Th17 in uveitic eyes.

In certain embodiments, the uveitis is posterior uveitis. Posterior uveitis presents primarily with inflammation of the retina and choroid and the examples demonstrate that the compositions of the invention are effective for reducing retinal inflammation and damage.

In certain embodiments, treatment with the compositions of the invention results in a reduction in retinal damage. In certain embodiments, the compositions of the invention are for use in reducing or preventing retinal damage in the treatment of uveitis. In certain embodiments, the compositions are for use in treating patients with severe uveitis that are at risk of retinal damage. In certain embodiments, treatment with the compositions of the invention results in a reduction in optic disc inflammation. In certain embodiments, the compositions of the invention are for use in reducing or preventing optic disc inflammation. In certain embodiments, treatment with the compositions of the invention results in a reduction in retinal tissue infiltration by inflammatory cells. In certain embodiments, the compositions of the invention are for use in reducing retinal tissue infiltration by inflammatory cells. In certain embodiments, treatment with the compositions of the invention results in vision being maintained or improved. In certain embodiments, the compositions of the invention are for use in maintaining or improving vision.

In certain embodiments, the compositions are for use in treating or preventing uveitis associated with a non-infectious or autoimmune disease, such as Behcet disease, Crohn's disease, Fuchs heterochromic iridocyclitis, granulomatosis with polyangiitis, HLA-B27 related uveitis, juvenile idiopathic arthritis, sarcoidosis, spondyloarthritis, sympathetic ophthalmia, tubulointerstitial nephritis and uveitis syndrome or Vogt-Koyanagi-Harada syndrome. IL-17A has been shown to be involved in, for example, Behcet and Vogt-Koyanagi-Harada diseases.

Treatment or prevention of uveitis may refer to, for example, an alleviation of the severity of symptoms or a prevention of relapse.

Cancer

In preferred embodiments, the compositions of the invention are for use in treating or preventing cancer. IL-17 and the Th17 pathway have central roles in cancer development and progression, and so the compositions of the invention may be useful for treating or preventing cancer.

Although the roles of IL-17 and Th17 cells in cancer are not fully understood, numerous pro-tumour effects of IL-17 and Th17 cells are known. For example, Th17 cells and IL-17 can promote angiogenesis, increase proliferation and survival of tumor cells and activate tumour-promoting transcription factors [42-44].

In certain embodiments, treatment with the compositions of the invention results in a reduction in tumour size or a reduction in tumour growth. In certain embodiments, the compositions of the invention are for use in reducing tumour size or reducing tumour growth. The compositions of the invention may be effective for reducing tumour size or growth. In certain embodiments, the compositions of the invention are for use in patients with solid tumours. In certain embodiments, the compositions of the invention are for use in reducing or preventing angiogenesis in the treatment of cancer. IL-17 and Th17 cells have central roles in angiogenesis. In certain embodiments, the compositions of the invention are for use in preventing metastasis.

In certain embodiments, the compositions of the invention are for use in treating or preventing breast cancer. The compositions of the invention may be effective for treating breast cancer, and IL-17 and Th17 cells have important roles in breast cancer [45]. In certain embodiments, the compositions of the invention are for use in reducing tumour size, reducing tumour growth, or reducing angiogenesis in the treatment of breast cancer. In preferred embodiments the cancer is mammary carcinoma. In preferred embodiments the cancer is stage IV breast cancer.

In certain embodiments, the compositions of the invention are for use in treating or preventing lung cancer. The compositions of the invention may be effective for treating lung cancer, and IL-17 and Th17 cells have important roles in lung cancer [46]. In certain embodiments, the compositions of the invention are for use in reducing tumour size, reducing tumour growth, or reducing angiogenesis in the treatment of lung cancer. In preferred embodiments the cancer is lung carcinoma.

In certain embodiments, the compositions of the invention are for use in treating or preventing liver cancer. The compositions of the invention may be effective for treating liver cancer, and IL-17 and Th17 cells have important roles in liver cancer [47]. In certain embodiments, the compositions of the invention are for use in reducing tumour size, reducing tumour growth, or reducing angiogenesis in the treatment of liver cancer. In preferred embodiments the cancer is hepatoma (hepatocellular carcinoma).

In certain embodiments, the compositions of the invention are for use in treating or preventing carcinoma. The compositions of the invention may be particularly effective for treating carcinoma. In certain embodiments, the compositions of the invention are for use in treating or preventing non-immunogenic cancer. The compositions of the invention may be effective for treating non-immunogenic cancers.

In further embodiments, the compositions of the invention are for use in treating or preventing acute lymphoblastic leukemia (ALL), acute myeloid leukemia, adrenocortical carcinoma, basal-cell carcinoma, bile duct cancer, bladder cancer, bone tumor, osteosarcoma/malignant fibrous histiocytoma, brainstem glioma, brain tumor, cerebellar astrocytoma, cerebral astrocytoma/malignant glioma, ependymoma, medulloblastoma, supratentorial primitive neuroectodermal tumors, breast cancer, bronchial adenomas/carcinoids, Burkitt's lymphoma, carcinoid tumor, cervical cancer, chronic lymphocytic leukemia, chronic myelogenous leukemia, chronic myeloproliferative disorders, colon cancer, cutaneous T-cell lymphoma, endometrial cancer, ependymoma, esophageal cancer, Ewing's sarcoma, intraocular melanoma, retinoblastoma, gallbladder cancer, gastric cancer, gastrointestinal carcinoid tumor, gastrointestinal stromal tumor (GIST), germ cell tumor, glioma, childhood visual pathway and hypothalamic, Hodgkin lymphoma, melanoma, islet cell carcinoma, Kaposi sarcoma, renal cell cancer, laryngeal cancer, leukaemias, lymphomas, mesothelioma, neuroblastoma, non-Hodgkin lymphoma, oropharyngeal cancer, osteosarcoma, ovarian cancer, pancreatic cancer, parathyroid cancer, pharyngeal cancer, pituitary adenoma, plasma cell neoplasia, prostate cancer, renal cell carcinoma, retinoblastoma, sarcoma, testicular cancer, thyroid cancer, or uterine cancer.

The compositions of the invention may be particularly effective when used in combination with further therapeutic agents. The immune-modulatory effects of the compositions of the invention may be effective when combined with more direct anti-cancer agents. Therefore, in certain embodiments, the invention provides a composition comprising a bacterial strain of the genus *Blautia* and an anticancer agent. In preferred embodiments the anticancer agent is an immune checkpoint inhibitor, a targeted antibody immunotherapy, a CAR-T cell therapy, an oncolytic virus, or a cytostatic drug. In preferred embodiments, the composition comprises an anti-cancer agent selected from the group consisting of: Yervoy (ipilimumab, BMS); Keytruda (pembrolizumab, Merck); Opdivo (nivolumab, BMS); MEDI4736 (AZ/MedImmune); MPDL3280A (Roche/Genentech); Tremelimumab (AZ/MedImmune); CT-011 (pidilizumab, CureTech); BMS-986015 (lirilumab, BMS); MEDI0680 (AZ/MedImmune); MSB-0010718C (Merck); PF-05082566 (Pfizer); MEDI6469 (AZ/MedImmune); BMS-986016 (BMS); BMS-663513 (urelumab, BMS); IMP321 (Prima Biomed); LAG525 (Novartis); ARGX-110 (arGEN-X); PF-05082466 (Pfizer); CDX-1127 (varlilumab; CellDex Therapeutics); TRX-518 (GITR Inc.); MK-4166 (Merck); JTX-2011 (Jounce Therapeutics); ARGX-115 (arGEN-X); NLG-9189 (indoximod, NewLink Genetics); INCB024360 (Incyte); IPH2201 (Innate Immotherapeutics/AZ); NLG-919 (NewLink Genetics); anti-VISTA (JnJ); Epacadostat (INCB24360, Incyte); F001287 (Flexus/BMS); CP 870893 (University of Pennsylvania); MGA271 (Macrogenix); Emactuzumab (Roche/Genentech); Galunisertib (Eli Lilly); Ulocuplumab (BMS); BKT140/BL8040 (Biokine Therapeutics); Bavituximab (Peregrine Pharmaceuticals); CC 90002 (Celgene); 852A (Pfizer); VTX-2337 (VentiRx Pharmaceuticals); IMO-2055 (Hybridon, Idera Pharmaceuticals); LY2157299 (Eli Lilly); EW-7197 (Ewha Women's University, Korea); Vemurafenib (Plexxikon); Dabrafenib (Genentech/GSK); BMS-777607 (BMS); BLZ945 (Memorial Sloan-Kettering Cancer Centre); Unituxin (dinutuximab, United Therapeutics Corporation); Blincyto (blinatumomab, Amgen); Cyramza (ramucirumab, Eli Lilly); Gazyva (obinutuzumab, Roche/Biogen); Kadcyla (ado-trastuzumab emtansine, Roche/Genentech); Perjeta (pertuzumab, Roche/Genentech); Adcetris (brentuximab vedotin, Takeda/Millennium); Arzerra (ofatumumab, GSK); Vectibix (panitumumab, Amgen); Avastin (bevacizumab, Roche/Genentech); Erbitux (cetuximab, BMS/Merck); Bexxar (tositumomab-I131, GSK); Zevalin (ibritumomab tiuxetan, Biogen); Campath (alemtuzumab, Bayer); Mylotarg (gemtuzumab ozogamicin, Pfizer); Herceptin (trastuzumab, Roche/Genentech); Rituxan (rituximab, Genentech/Biogen); volociximab (Abbvie); Enavatuzumab (Abbvie); ABT-414 (Abbvie); Elotuzumab (Abbvie/BMS); ALX-0141 (Ablynx); Ozaralizumab (Ablynx); Actimab-C (Actinium); Actimab-P (Actinium); Milatuzumab-dox (Actinium); Emab-SN-38 (Actinium); Naptumonmab estafenatox (Active Biotech); AFM13 (Affimed); AFM11 (Affimed); AGS-16C3F (Agensys); AGS-16M8F (Agensys); AGS-22ME (Agensys); AGS-15ME (Agensys); GS-67E (Agensys); ALXN6000 (samalizumab, Alexion); ALT-836 (Altor Bioscience); ALT-801 (Altor Bioscience); ALT-803 (Altor Bioscience); AMG780 (Amgen); AMG 228 (Amgen); AMG820 (Amgen); AMG172 (Amgen); AMG595 (Amgen); AMG110 (Amgen); AMG232 (adecatumumab, Amgen); AMG211 (Amgen/MedImmune); BAY20-10112 (Amgen/Bayer); Rilotumumab (Amgen); Denosumab (Amgen); AMP-514 (Amgen); MEDI575 (AZ/MedImmune); MEDI3617 (AZ/MedImmune); MEDI6383 (AZ/MedImmune); MEDI551 (AZ/MedImmune); Moxetumomab pasudotox (AZ/MedImmune); MEDI565 (AZ/MedImmune); MEDI0639 (AZ/MedImmune); MEDI0680 (AZ/MedImmune); MEDI562 (AZ/MedImmune); AV-380 (AVEO); AV203 (AVEO); AV299 (AVEO); BAY79-4620 (Bayer); Anetumab ravtansine (Bayer); vantictumab (Bayer); BAY94-9343 (Bayer); Sibrotuzumab (Boehringer Ingleheim); BI-836845 (Boehringer Ingleheim); B-701 (BioClin); BIIB015 (Biogen); Obinutuzumab (Biogen/Genentech); BI-505 (Bioinvent); BI-1206 (Bioinvent); TB-403 (Bioinvent); BT-062 (Biotest) BIL-010t (Biosceptre); MDX-1203 (BMS); MDX-1204 (BMS); Necitumumab (BMS); CAN-4 (Cantargia AB); CDX-011 (Celldex); CDX1401 (Celldex); CDX301 (Celldex); U3-1565 (Daiichi Sankyo); patritumab (Daiichi Sankyo); tigatuzumab (Daiichi Sankyo); nimotuzumab (Daiichi Sankyo); DS-8895 (Daiichi Sankyo); DS-8873 (Daiichi Sankyo); DS-5573 (Daiichi Sankyo); MORab-004 (Eisai); MORab-009 (Eisai); MORab-003 (Eisai); MORab-066 (Eisai); LY3012207 (Eli Lilly); LY2875358 (Eli Lilly); LY2812176 (Eli Lilly); LY3012217 (Eli Lilly); LY2495655 (Eli Lilly); LY3012212 (Eli Lilly); LY3012211 (Eli Lilly); LY3009806 (Eli Lilly); cixutumumab (Eli Lilly); Flanvotumab (Eli Lilly); IMC-TR1 (Eli Lilly); Ramucirumab (Eli Lilly); Tabalumab (Eli Lilly); Zanolimumab (Emergent Biosolution); FG-3019 (FibroGen); FPA008 (Five Prime Therapeutics); FP-1039 (Five Prime Therapeutics); FPA144 (Five Prime Therapeutics); catumaxomab (Fresenius Biotech); IMAB362 (Ganymed); IMAB027 (Ganymed); HuMax-CD74 (Genmab); HuMax-TFADC (Genmab); GS-5745 (Gilead); GS-6624 (Gilead); OMP-21M18 (demcizumab, GSK); mapatumumab (GSK); IMGN289 (ImmunoGen); IMGN901 (ImmunoGen); IMGN853 (ImmunoGen); IMGN529 (ImmunoGen); IMMU-130 (Immunomedics); milatuzumab-dox (Immunomedics); IMMU-115 (Immunomedics); IMMU-132 (Immunomedics); IMMU-106 (Immunomedics); IMMU-102 (Immunomedics); Epratuzumab (Immunomedics); Clivatuzumab (Immunomedics); IPH41 (Innate Immunotherapeutics); Daratumumab (Janssen/Genmab); CNTO-95 (Intetumumab, Janssen); CNTO-328 (siltuximab, Janssen); KB004 (KaloBios); mogamulizumab (Kyowa Hakko Kirrin); KW-2871 (ecromeximab, Life Science); Sonepcizumab (Lpath); Margetuximab (Macrogenics); Enoblituzumab (Macrogenics); MGD006 (Macrogenics); MGF007 (Macrogenics); MK-0646 (dalotuzumab, Merck); MK-3475 (Merck); Sym004 (Symphogen/Merck Serono); DI17E6 (Merck Serono); MOR208 (Morphosys); MOR202 (Morphosys); Xmab5574 (Morphosys); BPC-1C (ensituximab, Precision Biologics); TAS266 (Novartis); LFA102 (Novartis); BHQ880 (Novartis/Morphosys); QGE031 (Novartis); HCD122 (lucatumumab, Novartis); LJM716 (Novartis); AT355 (Novartis); OMP-21M18 (Demcizumab, OncoMed); OMP52M51 (Oncomed/GSK); OMP-59R5 (Oncomed/GSK); vantictumab (Oncomed/Bayer); CMC-544 (inotuzumab ozogamicin, Pfizer); PF-03446962 (Pfizer); PF-04856884 (Pfizer); PSMA-ADC (Progenics); REGN1400 (Regeneron); REGN910 (nesvacumab, Regeneron/Sanofi); REGN421 (enoticumab, Regeneron/Sanofi); RG7221, RG7356, RG7155, RG7444, RG7116, RG7458, RG7598, RG7599, RG7600, RG7636, RG7450, RG7593, RG7596, DCDS3410A, RG7414 (parsatuzumab), RG7160 (imgatuzumab), RG7159 (obinutuzumab), RG7686, RG3638 (onartuzumab), RG7597 (Roche/Genentech); SAR307746 (Sanofi); SAR566658 (Sanofi); SAR650984 (Sanofi); SAR153192 (Sanofi); SAR3419 (Sanofi); SAR256212 (Sanofi), SGN-LIV1A (lintuzumab, Seattle Genetics); SGN-CD33A (Seattle Genetics); SGN-75 (vorsetuzumab mafodotin, Seattle Genetics); SGN-19A (Seattle Genetics) SGN-CD70A (Seattle Genetics); SEA-CD40 (Seattle Genetics); ibritumomab tiuxetan (Spectrum); MLN0264 (Takeda); ganitumab (Takeda/Amgen); CEP-37250 (Teva); TB-403 (Thrombogenic); VB4-845 (Viventia); Xmab2512 (Xencor); Xmab5574 (Xencor); nimotuzumab (YM Biosciences); Carlumab (Janssen); NY-ESO TCR (Adaptimmune); MAGE-A-10 TCR (Adaptimmune); CTL019 (Novartis); JCAR015 (Juno Therapeutics); KTE-C19 CAR (Kite Pharma); UCART19 (Cellectis); BPX-401 (Bellicum Pharmaceuticals); BPX-601 (Bellicum Pharmaceuticals); ATTCK20 (Unum Therapeutics); CAR-NKG2D (Celyad); Onyx-015 (Onyx Pharmaceuticals); H101 (Shanghai Sunwaybio); DNX-2401 (DNAtrix); VCN-01 (VCN Biosciences); Colo-Adl (PsiOxus Therapeutics); ProstAtak (Advantagene); Oncos-102 (Oncos Therapeutics); CG0070 (Cold Genesys); Pexa-vac (JX-594, Jennerex Biotherapeutics); GL-ONC1 (Genelux); T-VEC (Amgen); G207 (Medigene); HF10 (Takara Bio); SEPREHVIR (HSV1716, Virttu Biologics); OrienX010 (OrienGene Biotechnology); Reolysin (Oncolytics Biotech); SVV-001 (Neotropix); Cacatak (CVA21, Viralytics); Alimta (Eli Lilly), cisplatin, oxaliplatin, irinotecan, folinic acid, methotrexate, cyclophosphamide, 5-fluorouracil, Zykadia (Novartis), Tafinlar (GSK), Xalkori (Pfizer), Iressa (AZ), Gilotrif (Boehringer Ingelheim), Tarceva (Astellas Pharma), Halaven (Eisai Pharma), Veliparib (Abbvie), AZD9291 (AZ), Alectinib (Chugai), LDK378 (Novartis), Genetespib (Synta Pharma), Tergenpumatucel-L (NewLink Genetics), GV1001 (Kael-GemVax), Tivantinib (ArQule); Cytoxan (BMS); Oncovin (Eli Lilly); Adriamycin (Pfizer); Gemzar (Eli Lilly); Xeloda (Roche); Ixempra (BMS); Abraxane (Celgene); Trelstar (Debiopharm); Taxotere (Sanofi); Nexavar (Bayer); IMMU-132 (Immunomedics); E7449 (Eisai); Thermodox (Celsion); Cometriq (Exellxis); Lonsurf (Taiho Pharmaceuticals); Camptosar (Pfizer); UFT (Taiho Pharmaceuticals); and TS-1 (Taiho Pharmaceuticals).

Modes of Administration

Preferably, the compositions of the invention are to be administered to the gastrointestinal tract in order to enable delivery to and/or partial or total colonisation of the intestine with the bacterial strain of the invention. Generally, the compositions of the invention are administered orally, but they may be administered rectally, intranasally, or via buccal or sublingual routes.

In certain embodiments, the compositions of the invention may be administered as a foam, as a spray or a gel.

In certain embodiments, the compositions of the invention may be administered as a suppository, such as a rectal suppository, for example in the form of a theobroma oil (cocoa butter), synthetic hard fat (e.g. suppocire, witepsol), glycero-gelatin, polyethylene glycol, or soap glycerin composition.

In certain embodiments, the composition of the invention is administered to the gastrointestinal tract via a tube, such as a nasogastric tube, orogastric tube, gastric tube, jejunostomy tube (J tube), percutaneous endoscopic gastrostomy (PEG), or a port, such as a chest wall port that provides access to the stomach, jejunum and other suitable access ports.

The compositions of the invention may be administered once, or they may be administered sequentially as part of a treatment regimen. In certain embodiments, the compositions of the invention are to be administered daily.

In certain embodiments of the invention, treatment according to the invention is accompanied by assessment of the patient's gut microbiota. Treatment may be repeated if delivery of and/or partial or total colonisation with the strain of the invention is not achieved such that efficacy is not observed, or treatment may be ceased if delivery and/or partial or total colonisation is successful and efficacy is observed.

In certain embodiments, the composition of the invention may be administered to a pregnant animal, for example a mammal such as a human in order to prevent an inflammatory or autoimmune disease developing in her child in utero and/or after it is born.

The compositions of the invention may be administered to a patient that has been diagnosed with a disease or condition mediated by IL-17 or the Th17 pathway, or that has been identified as being at risk of a disease or condition mediated by IL-17 or the Th17 pathway. The compositions may also be administered as a prophylactic measure to prevent the development of diseases or conditions mediated by IL-17 or the Th17 pathway in a healthy patient.

The compositions of the invention may be administered to a patient that has been identified as having an abnormal gut microbiota. For example, the patient may have reduced or absent colonisation by *Blautia*, and in particular *Blautia stercoris* or *Blautia wexlerae*.

The compositions of the invention may be administered as a food product, such as a nutritional supplement.

Generally, the compositions of the invention are for the treatment of humans, although they may be used to treat animals including monogastric mammals such as poultry, pigs, cats, dogs, horses or rabbits. The compositions of the invention may be useful for enhancing the growth and performance of animals. If administered to animals, oral gavage may be used.

Compositions

Generally, the composition of the invention comprises bacteria. In preferred embodiments of the invention, the composition is formulated in freeze-dried form. For example, the composition of the invention may comprise granules or gelatin capsules, for example hard gelatin capsules, comprising a bacterial strain of the invention.

Preferably, the composition of the invention comprises lyophilised bacteria. Lyophilisation of bacteria is a well-established procedure and relevant guidance is available in, for example, references [48-50].

Alternatively, the composition of the invention may comprise a live, active bacterial culture.

In preferred embodiments, the composition of the invention is encapsulated to enable delivery of the bacterial strain to the intestine. Encapsulation protects the composition from degradation until delivery at the target location through, for example, rupturing with chemical or physical stimuli such as pressure, enzymatic activity, or physical disintegration, which may be triggered by changes in pH. Any appropriate encapsulation method may be used. Exemplary encapsulation techniques include entrapment within a porous matrix, attachment or adsorption on solid carrier surfaces, self-aggregation by flocculation or with cross-linking agents, and mechanical containment behind a microporous membrane or a microcapsule. Guidance on encapsulation that may be useful for preparing compositions of the invention is available in, for example, references [51] and [52].

The composition may be administered orally and may be in the form of a tablet, capsule or powder. Encapsulated products are preferred because *Blautia* are anaerobes. Other ingredients (such as vitamin C, for example), may be included as oxygen scavengers and prebiotic substrates to improve the delivery and/or partial or total colonisation and survival in vivo. Alternatively, the probiotic composition of the invention may be administered orally as a food or nutritional product, such as milk or whey based fermented dairy product, or as a pharmaceutical product.

The composition may be formulated as a probiotic.

A composition of the invention includes a therapeutically effective amount of a bacterial strain of the invention. A therapeutically effective amount of a bacterial strain is sufficient to exert a beneficial effect upon a patient. A therapeutically effective amount of a bacterial strain may be sufficient to result in delivery to and/or partial or total colonisation of the patient's intestine.

A suitable daily dose of the bacteria, for example for an adult human, may be from about $1 \times 10^3$ to about $1 \times 10^{11}$ colony forming units (CFU); for example, from about $1 \times 10^7$ to about $1 \times 10^{10}$ CFU; in another example from about $1 \times 10^6$ to about $1 \times 10^{10}$ CFU.

In certain embodiments, the composition contains the bacterial strain in an amount of from about $1 \times 10^6$ to about $1 \times 10^{11}$ CFU/g, respect to the weight of the composition; for example, from about $1 \times 10^8$ to about $1 \times 10^{10}$ CFU/g. The dose may be, for example, 1 g, 3 g, 5 g, and 10 g.

Typically, a probiotic, such as the composition of the invention, is optionally combined with at least one suitable prebiotic compound. A prebiotic compound is usually a non-digestible carbohydrate such as an oligo- or polysaccharide, or a sugar alcohol, which is not degraded or absorbed in the upper digestive tract. Known prebiotics include commercial products such as inulin and transgalacto-oligosaccharides.

In certain embodiments, the probiotic composition of the present invention includes a prebiotic compound in an amount of from about 1 to about 30% by weight, respect to the total weight composition, (e.g. from 5 to 20% by weight). Carbohydrates may be selected from the group consisting of: fructo-oligosaccharides (or FOS), short-chain fructo-oligosaccharides, inulin, isomalt-oligosaccharides, pectins, xylo-oligosaccharides (or XOS), chitosan-oligosaccharides (or COS), beta-glucans, arable gum modified and resistant starches, polydextrose, D-tagatose, acacia fibers, carob, oats, and citrus fibers. In one aspect, the prebiotics are the short-chain fructo-oligosaccharides (for simplicity shown herein below as FOSs-c.c); said FOSs-c.c. are not digestible carbohydrates, generally obtained by the conversion of the beet sugar and including a saccharose molecule to which three glucose molecules are bonded.

The compositions of the invention may comprise pharmaceutically acceptable excipients or carriers. Examples of such suitable excipients may be found in the reference [53]. Acceptable carriers or diluents for therapeutic use are well known in the pharmaceutical art and are described, for example, in reference [54]. Examples of suitable carriers include lactose, starch, glucose, methyl cellulose, magnesium stearate, mannitol, sorbitol and the like. Examples of suitable diluents include ethanol, glycerol and water. The choice of pharmaceutical carrier, excipient or diluent can be selected with regard to the intended route of administration and standard pharmaceutical practice. The pharmaceutical compositions may comprise as, or in addition to, the carrier, excipient or diluent any suitable binder(s), lubricant(s), suspending agent(s), coating agent(s), solubilising agent(s). Examples of suitable binders include starch, gelatin, natural sugars such as glucose, anhydrous lactose, free-flow lactose, beta-lactose, corn sweeteners, natural and synthetic gums, such as acacia, tragacanth or sodium alginate, carboxymethyl cellulose and polyethylene glycol. Examples of suitable lubricants include sodium oleate, sodium stearate, magnesium stearate, sodium benzoate, sodium acetate, sodium chloride and the like. Preservatives, stabilizers, dyes and even flavouring agents may be provided in the pharmaceutical composition. Examples of preservatives include sodium benzoate, sorbic acid and esters of p-hydroxybenzoic acid. Antioxidants and suspending agents may be also used.

The compositions of the invention may be formulated as a food product. For example, a food product may provide nutritional benefit in addition to the therapeutic effect of the invention, such as in a nutritional supplement. Similarly, a food product may be formulated to enhance the taste of the composition of the invention or to make the composition more attractive to consume by being more similar to a common food item, rather than to a pharmaceutical composition. In certain embodiments, the composition of the invention is formulated as a milk-based product. The term "milk-based product" means any liquid or semi-solid milk- or whey-based product having a varying fat content. The milk-based product can be, e.g., cow's milk, goat's milk, sheep's milk, skimmed milk, whole milk, milk recombined from powdered milk and whey without any processing, or a processed product, such as yoghurt, curdled milk, curd, sour milk, sour whole milk, butter milk and other sour milk products. Another important group includes milk beverages, such as whey beverages, fermented milks, condensed milks, infant or baby milks; flavoured milks, ice cream; milk-containing food such as sweets.

In certain embodiments, the compositions of the invention contain a single bacterial strain or species and do not contain any other bacterial strains or species. Such compositions may comprise only de minimis or biologically irrelevant amounts of other bacterial strains or species. Such compositions may be a culture that is substantially free from other species of organism.

The compositions for use in accordance with the invention may or may not require marketing approval.

In some cases, the lyophilised bacterial strain is reconstituted prior to administration. In some cases, the reconstitution is by use of a diluent described herein.

The compositions of the invention can comprise pharmaceutically acceptable excipients, diluents or carriers.

In certain embodiments, the invention provides a pharmaceutical composition comprising: a bacterial strain of the invention; and a pharmaceutically acceptable excipient, carrier or diluent; wherein the bacterial strain is in an amount sufficient to treat a disorder when administered to a subject in need thereof; and wherein the disorder is selected from the group consisting of asthma, allergic asthma, neutrophilic asthma, osteoarthritis, psoriatic arthritis, juvenile idiopathic arthritis, neuromyelitis optica (Devic's disease), ankylosing spondylitis, spondyloarthritis, systemic lupus erythematosus, celiac disease, chronic obstructive pulmonary disease (COPD), cancer, breast cancer, colon cancer, lung cancer, ovarian cancer, uveitis, scleritis, vasculitis, Behcet's disease, atherosclerosis, atopic dermatitis, emphysema, periodontitis, allergic rhinitis, and allograft rejection.

In certain embodiments, the invention provides pharmaceutical composition comprising: a bacterial strain of the invention; and a pharmaceutically acceptable excipient, carrier or diluent; wherein the bacterial strain is in an amount sufficient to treat or prevent a disease or condition mediated by IL-17 or the Th17 pathway. In preferred embodiments, said disease or condition is selected from the group consisting of rheumatoid arthritis, multiple sclerosis, psoriasis, inflammatory bowel disease, Crohn's disease, ulcerative colitis, celiac disease, asthma, allergic asthma, neutrophilic asthma, osteoarthritis, psoriatic arthritis, juvenile idiopathic arthritis, neuromyelitis optica (Devic's disease), ankylosing spondylitis, spondyloarthritis, systemic lupus erythematosus, chronic obstructive pulmonary disease (COPD), cancer, breast cancer, colon cancer, lung cancer, ovarian cancer, uveitis, scleritis, vasculitis, Behcet's disease, atherosclerosis, atopic dermatitis, emphysema, periodontitis, allergic rhinitis, and allograft rejection.

In certain embodiments, the invention provides the above pharmaceutical composition, wherein the amount of the bacterial strain is from about $1 \times 10^3$ to about $1 \times 10^{11}$ colony forming units per gram with respect to a weight of the composition.

In certain embodiments, the invention provides the above pharmaceutical composition, wherein the composition is administered at a dose of 1 g, 3 g, 5 g or 10 g.

In certain embodiments, the invention provides the above pharmaceutical composition, wherein the composition is administered by a method selected from the group consisting of oral, rectal, subcutaneous, nasal, buccal, and sublingual.

In certain embodiments, the invention provides the above pharmaceutical composition, comprising a carrier selected from the group consisting of lactose, starch, glucose, methyl cellulose, magnesium stearate, mannitol and sorbitol.

In certain embodiments, the invention provides the above pharmaceutical composition, comprising a diluent selected from the group consisting of ethanol, glycerol and water.

In certain embodiments, the invention provides the above pharmaceutical composition, comprising an excipient selected from the group consisting of starch, gelatin, glucose, anhydrous lactose, free-flow lactose, beta-lactose, corn sweetener, acacia, tragacanth, sodium alginate, carboxymethyl cellulose, polyethylene glycol, sodium oleate, sodium stearate, magnesium stearate, sodium benzoate, sodium acetate and sodium chloride.

In certain embodiments, the invention provides the above pharmaceutical composition, further comprising at least one of a preservative, an antioxidant and a stabilizer.

In certain embodiments, the invention provides the above pharmaceutical composition, comprising a preservative selected from the group consisting of sodium benzoate, sorbic acid and esters of p-hydroxybenzoic acid.

In certain embodiments, the invention provides the above pharmaceutical composition, wherein said bacterial strain is lyophilised.

In certain embodiments, the invention provides the above pharmaceutical composition, wherein when the composition is stored in a sealed container at about 4.0 or about 25.0 and the container is placed in an atmosphere having 50% relative humidity, at least 80% of the bacterial strain as measured in colony forming units, remains after a period of at least about: 1 month, 3 months, 6 months, 1 year, 1.5 years, 2 years, 2.5 years or 3 years.

Culturing Methods

The bacterial strains for use in the present invention can be cultured using standard microbiology techniques as detailed in, for example, references [55-57].

The solid or liquid medium used for culture may be YCFA agar or YCFA medium. YCFA medium may include (per 100 ml, approximate values): Casitone (1.0 g), yeast extract (0.25 g), $NaHCO_3$ (0.4 g), cysteine (0.1 g), $K_2HPO_4$ (0.045 g), $KH_2PO_4$ (0.045 g), NaCl (0.09 g), $(NH_4)_2SO_4$ (0.09 g), $MgSO_4 \cdot 7H_2O$ (0.009 g), $CaCl_2$ (0.009 g), resazurin (0.1 mg), hemin (1 mg), biotin (1 µg), cobalamin (1 µg), p-aminobenzoic acid (3 µg), folic acid (5 µg), and pyridoxamine (15 µg).

Bacterial Strains for Use in Vaccine Compositions

The inventors have identified that the bacterial strains of the invention are useful for treating or preventing diseases or conditions mediated by IL-17 or the Th17 pathway. This is likely to be a result of the effect that the bacterial strains of the invention have on the host immune system. Therefore, the compositions of the invention may also be useful for preventing diseases or conditions mediated by IL-17 or the Th17 pathway, when administered as vaccine compositions. In certain such embodiments, the bacterial strains of the invention may be killed, inactivated or attenuated. In certain such embodiments, the compositions may comprise a vaccine adjuvant. In certain embodiments, the compositions are for administration via injection, such as via subcutaneous injection.

General

The practice of the present invention will employ, unless otherwise indicated, conventional methods of chemistry, biochemistry, molecular biology, immunology and pharmacology, within the skill of the art. Such techniques are explained fully in the literature. See, e.g., references [58] and [59-65], etc.

The term "comprising" encompasses "including" as well as "consisting" e.g. a composition "comprising" X may consist exclusively of X or may include something additional e.g. X+Y.

The term "about" in relation to a numerical value x is optional and means, for example, x±10%.

The word "substantially" does not exclude "completely" e.g. a composition which is "substantially free" from Y may be completely free from Y. Where necessary, the word "substantially" may be omitted from the definition of the invention.

References to a percentage sequence identity between two nucleotide sequences means that, when aligned, that percentage of nucleotides are the same in comparing the two sequences. This alignment and the percent homology or sequence identity can be determined using software programs known in the art, for example those described in section 7.7.18 of ref [66]. A preferred alignment is determined by the Smith-Waterman homology search algorithm using an affine gap search with a gap open penalty of 12 and a gap extension penalty of 2, BLOSUM matrix of 62. The Smith-Waterman homology search algorithm is disclosed in ref. [67].

Unless specifically stated, a process or method comprising numerous steps may comprise additional steps at the beginning or end of the method, or may comprise additional intervening steps. Also, steps may be combined, omitted or performed in an alternative order, if appropriate.

Various embodiments of the invention are described herein. It will be appreciated that the features specified in each embodiment may be combined with other specified features, to provide further embodiments. In particular, embodiments highlighted herein as being suitable, typical or preferred may be combined with each other (except when they are mutually exclusive).

MODES FOR CARRYING OUT THE INVENTION

Example 1—Efficacy of Bacterial Inocula in a Mouse Model of House Dust Mite-Induced Asthma Summary Mice were administered with compositions comprising bacterial strains according to the invention and were subsequently challenged with house dust mite (HDM) extract to elicit an allergic inflammatory response. The inflammatory response to HDM includes eosinophilic and neutrophilic components, is mediated by IL-17 and the Th17 pathway, and is a model for asthma. The magnitude and characteristics of the inflammatory response exhibited by mice treated with compositions of the invention were compared to control groups. The compositions of the invention were found to alleviate the inflammatory response, and to reduce recruitment of eosinophils and neutrophils, indicating that they may be useful for treating IL-17- and Th17-mediated conditions such as eosinophilia, neutrophilia and asthma.

Strain

830: *Blautia stercoris*

Study Design

Groups:

1. Negative control group. Treatment with vehicle control (per oral).
6. Treatment with therapeutic bacteria inoculum strain 830 (per oral).
7. Positive control group. Treatment with Dexamethasone (i.p.).
8. Untreated Control Group.

Number of mice per group=5

Day −14 to day 13: Daily administration of vehicle control per oral (Group 1).

Day −14 to day 13: Daily administration of therapeutic bacteria inoculum per oral (Group 2-6).

Day 0, 2, 4, 7, 9, 11 Administration of 15 ug HDM (house dust mite extract—Catalogue number: XPB70D3A25, Lot number: 231897, Greer Laboratories, Lenoir, N.C., USA) in a volume of 30 ul PBS per nasal (Group 1-8).

Day 0, 2, 4, 7, 9, 11 Administration of Dexamethasone (i.p., 3 mg/kg, Sigma-Aldrich, Catalogue number D1159) (Group 7).

Day 14 Sacrifice of all animals for analysis.

Total number of mice=40.

Endpoints and Analysis

On day 14 animals were sacrificed by lethal intraperitoneal injection with pentabarbitol (Streuli Pharma AG, Uznach, Cat: 1170139A) immediately followed by a bronchoalveolar lavage (BAL).

Cells were isolated from the BAL (bronchoalveolar lavage) fluid and differential cell counts performed (200 cell counts/samples).

Material and Methods

Mice.

Female 7 week old BALB/c mice were purchased from Charles River Laboratories and randomly allocated to cages totally 5 mice per cage (Ventilated cages sourced from Indulab AG, Gams, Switzerland Cage type: "The Sealsafe™—IVC cage. Product number 1248L). Cages were labeled with study number, group number and experimental starting date. Mice were monitored weekly and acclimatized to facility for 7 days prior to initiation of study (Study Day −14). Animals were 8 weeks old on Study Day −14. Potable water and food were available ad libitum. Cage enrichment was present. Daily care of the animals was performed according to local authorization license number 2283.1 (issued and approved by: Service de la consommation et des affaires vétérinaires du Canton de Vaud). Potable water and food were available ad libitum and refreshed once daily. Cage enrichment was present. Animal welfare regulations were observed as given by official authorities of Switzerland under ordinance 455.163 of the FVO (Federal Veterinary Office) on laboratory animal husbandry, production of genetically modified animals, and methods of animal experimentation.

Culturing of Bacteria Inoculum.

Within a sterile workstation, a cryo-vial of bacteria was thawed by warming in gloved hand and ~0.7 ml of contents injected into a Hungate tube (Cat Number, 1020471, Glasgerätebau Ochs, Bovenden-Lenglern, Germany), containing 8 ml of anaerobic YCFA. Two tubes per strain were usually prepared. The Hungate tubes were then incubated (static) at 37° C. for up to 24-26 hours (for strain 830).

Culturing of Vehicle Control.

A Hungate tube containing 8 ml of anaerobic YCFA was incubated (static) at 37° C. for 16 h.

Administration of Bacteria Inoculum or Vehicle Control.

400 ul of cultured bacteria inoculum or vehicle control were administered per day per oral gavage.

Intranasal Sensitization.

Mice were anesthetized by i.p. injection with 9.75 mg xylasol and 48.75 mg ketasol per kg (Dr. E. Graeub AG, Bern, Switzerland) and administered with 15 ug of HDM (Catalogue number: XPB70D3A25, Lot number: 231897, Greer Laboratories, Lenoir, N.C., USA) in a volume of 30 ul PBS per nasal.

Preparation and Administration of Positive Control Compound Dexamethasone.

Dexamethasone 21-phosphate disodium salt (Sigma-Aldrich, Catalogue number D1159, Lot N° SLBD.1030V) was solved in $H_2O$ and administered to the animals in a dose of 3 mg/kg in a volume of 200 ul per oral at days indicated in study protocol above.

Terminal Procedure.

On day 14 animals were sacrificed by lethal i.p. injection with pentabarbitol (Streuli Pharma AG, Uznach, Cat: 1170139A) immediately followed by bronchoalveolar lavage (BAL) in 500 ul of saline.

Measurement of Cellular Infiltrates into BAL.

Cells were isolated from the BAL fluid and differential cell counts were performed based upon standard morphological and cytochemical criteria.

Graphs and Statistical Analysis.

All graphs were generated with Graphpad Prism Version 6 and a one-way ANOVA was applied. Results from the statistical analysis were provided with the individual data tables. Error bars represent Standard Error of the Mean (SEM).

Results and Analysis

The results of the experiments are shown in FIGS. 1-9.

No morbidity or mortality was noted in the mice treated with the bacteria or the vehicle. The two controls, vehicle treatment (negative control) and the dexamethasone treatment (positive control) behaved as expected, with impaired eosinophilia and neutrophilia noted following dexamethasone treatment.

Figure 6:
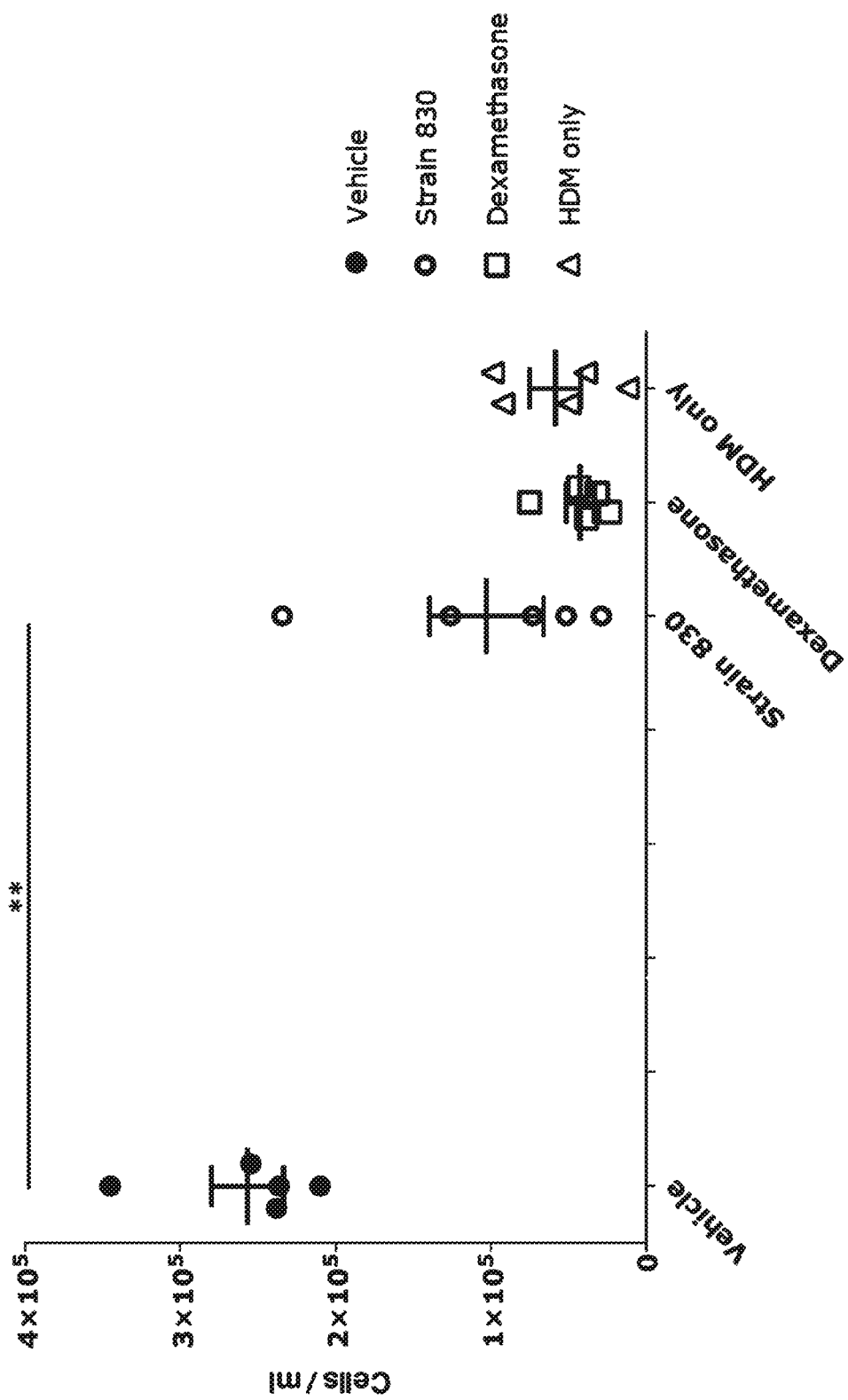
FIG. 6: Mouse model of house dust mite-induced asthma—Total neutrophil count in BALF.
Figure 7:
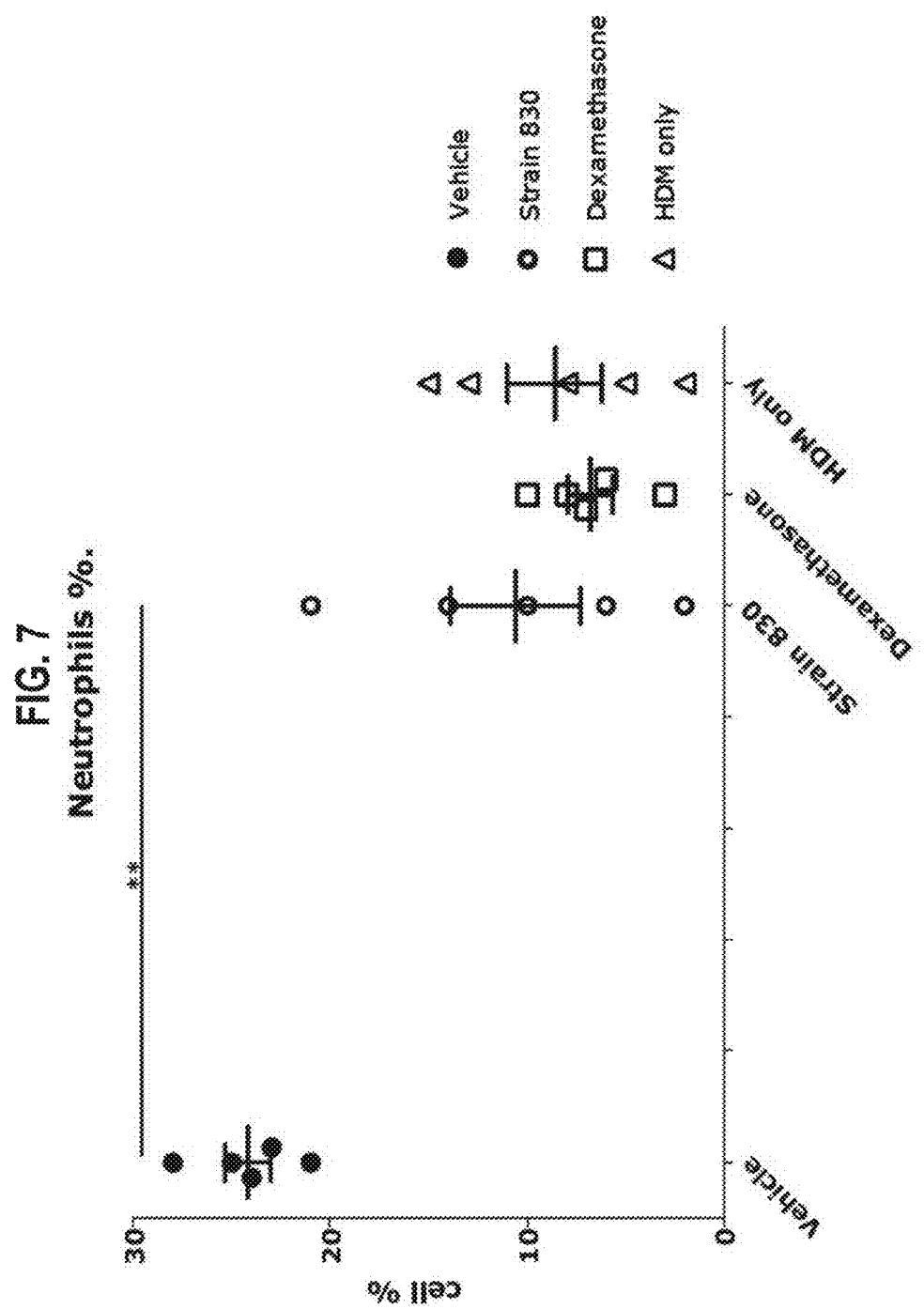
FIG. 7: Mouse model of house dust mite-induced asthma—Proportion of neutrophils in BALF.
Figure 8:
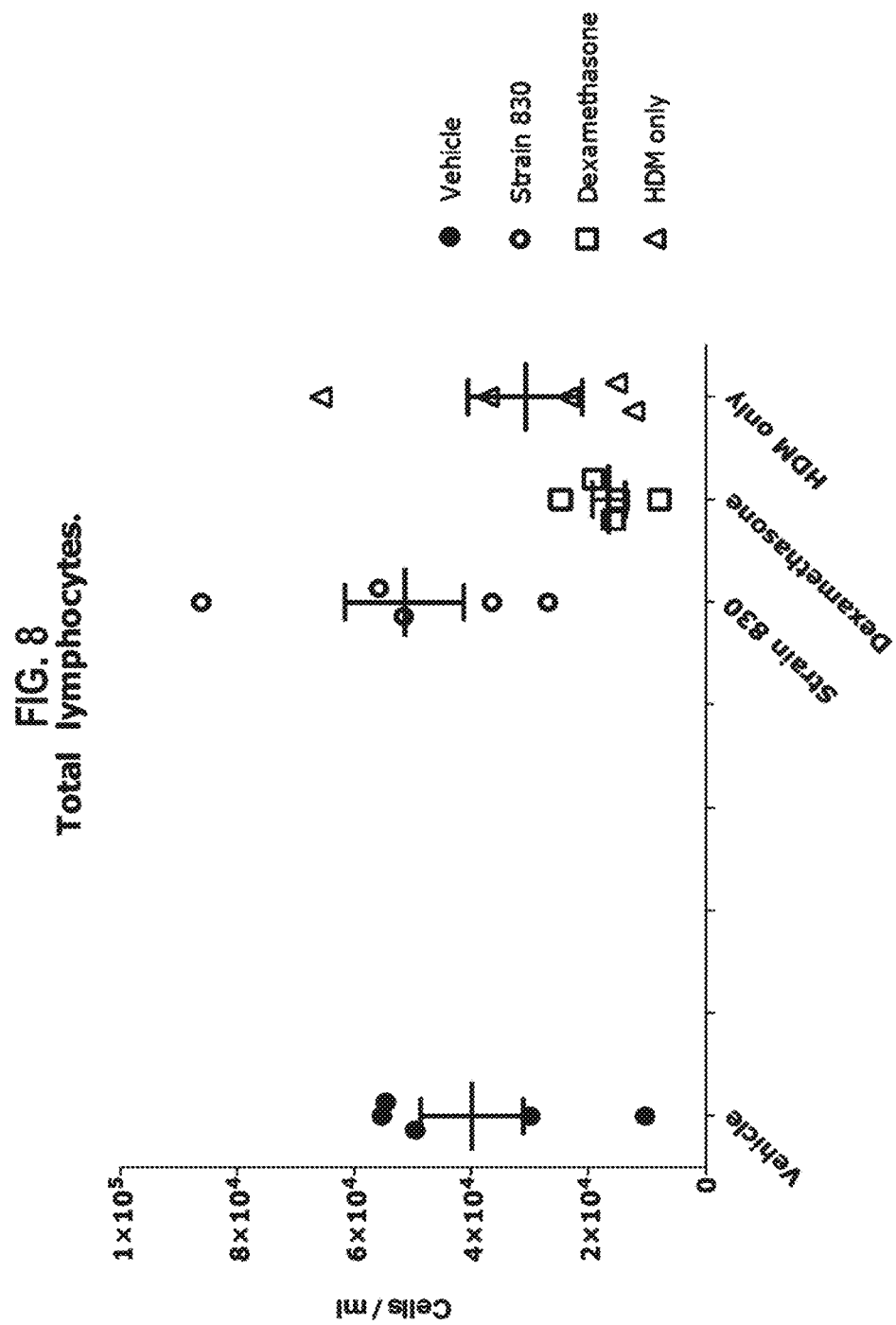
FIG. 8: Mouse model of house dust mite-induced asthma—Total lymphocyte count in BALF.
Figure 9:
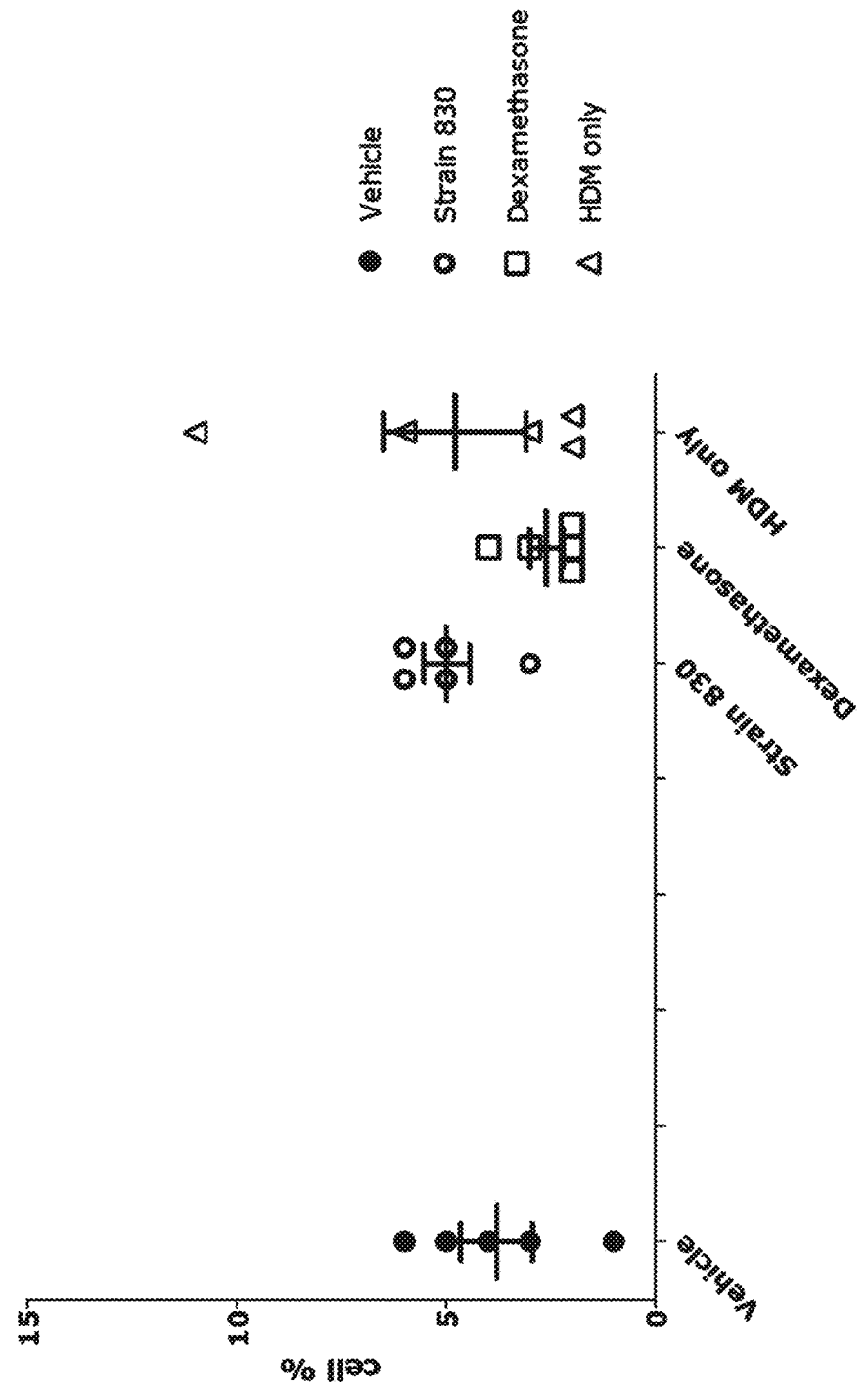
FIG. 9: Mouse model of house dust mite-induced asthma—Proportion of lymphocytes in BALF.
Figure 10:
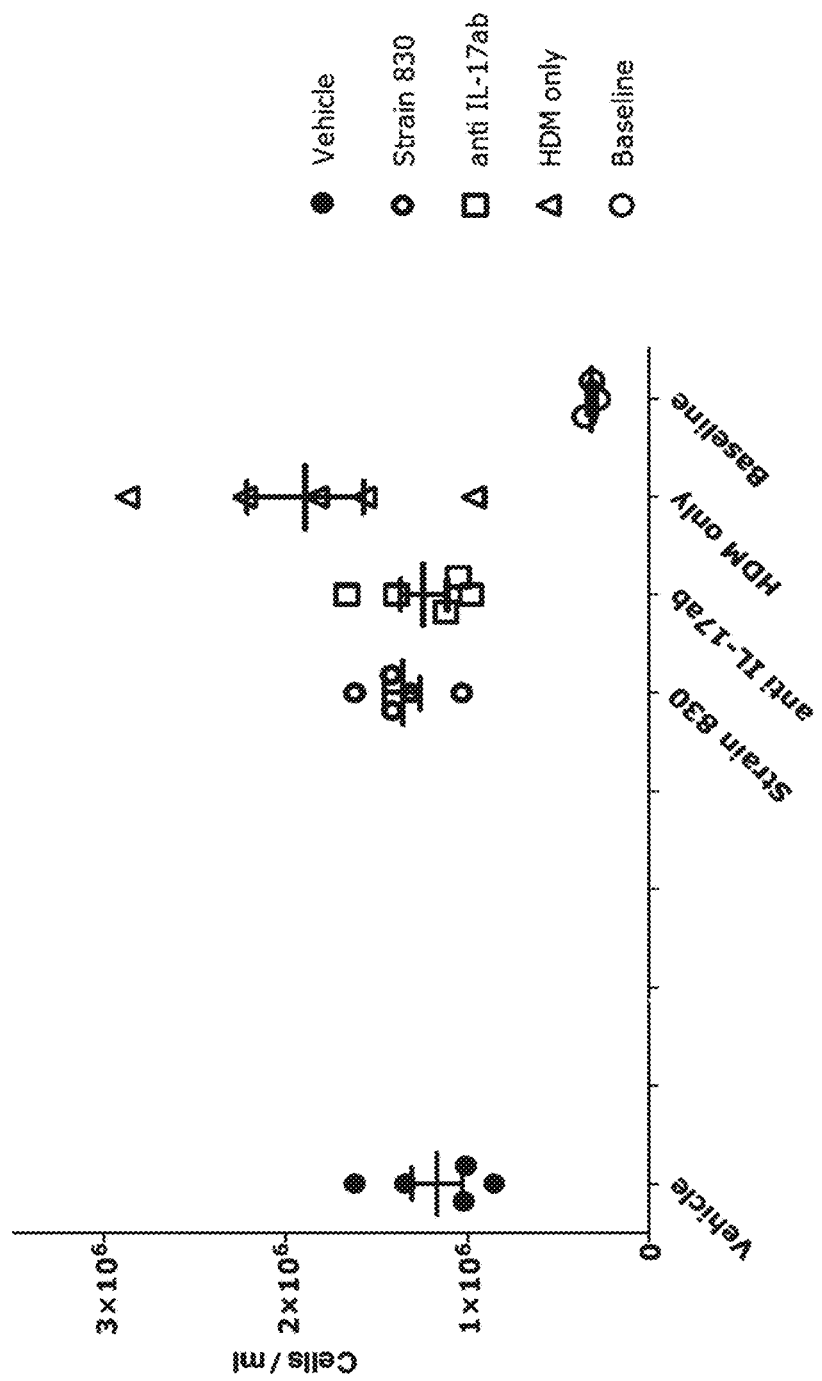
FIG. 10: Mouse model of severe neutrophilic asthma—Total BAL fluid cell counts.
Figure 11:
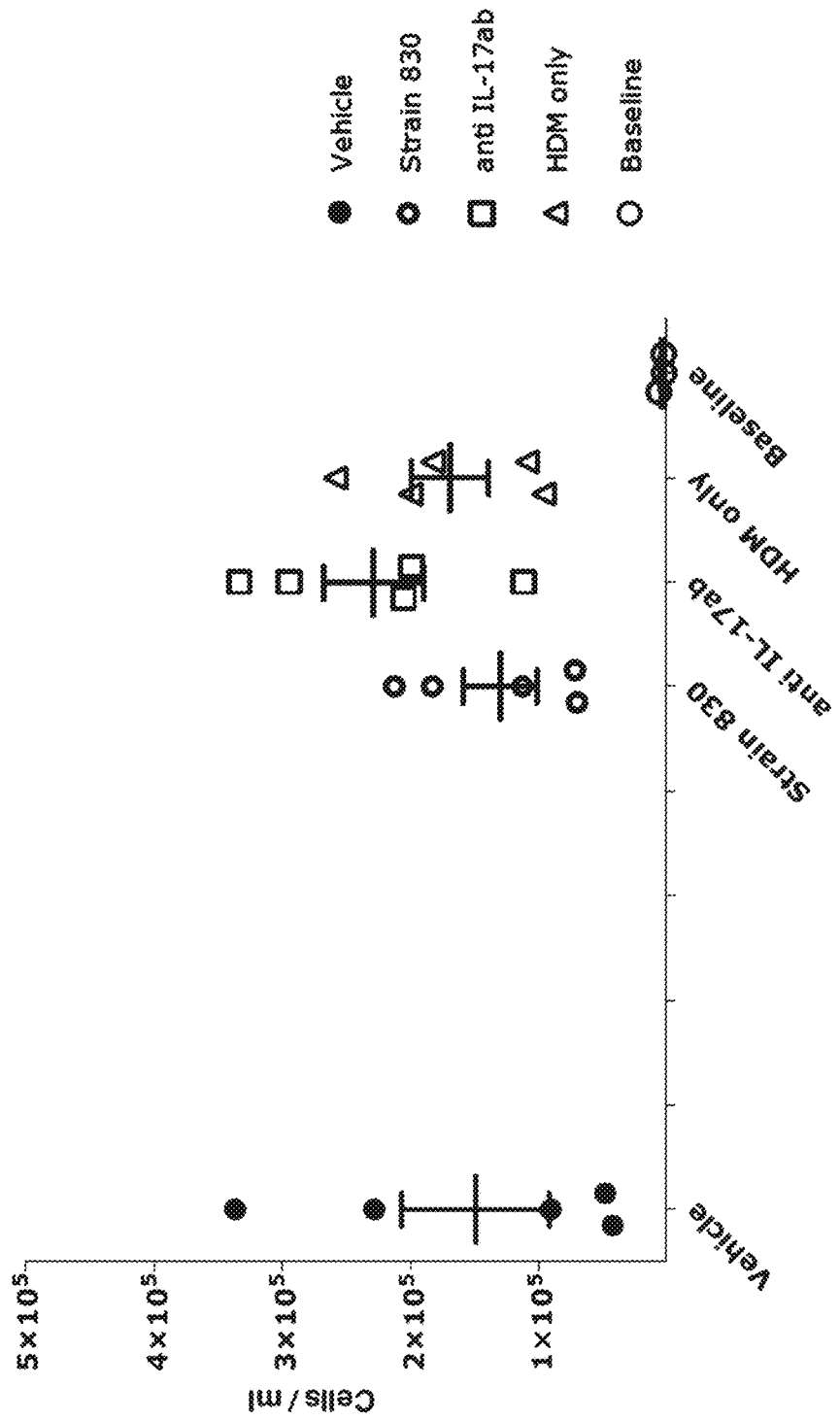
FIG. 11: Mouse model of severe neutrophilic asthma—Total eosinophil count in BALF.
Figure 12:
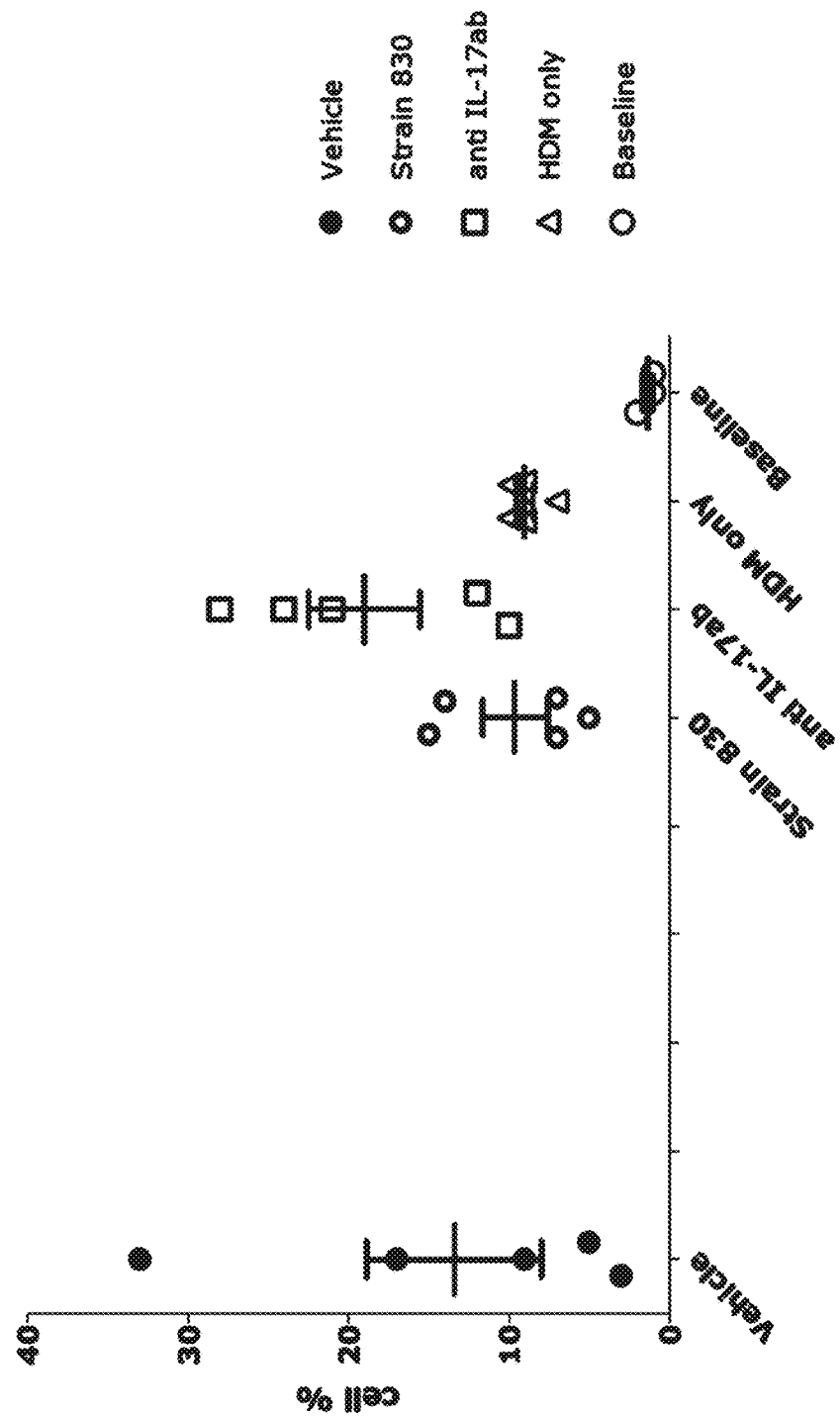
FIG. 12: Mouse model of severe neutrophilic asthma—Proportion of eosinophils in BALF.
Figure 13:
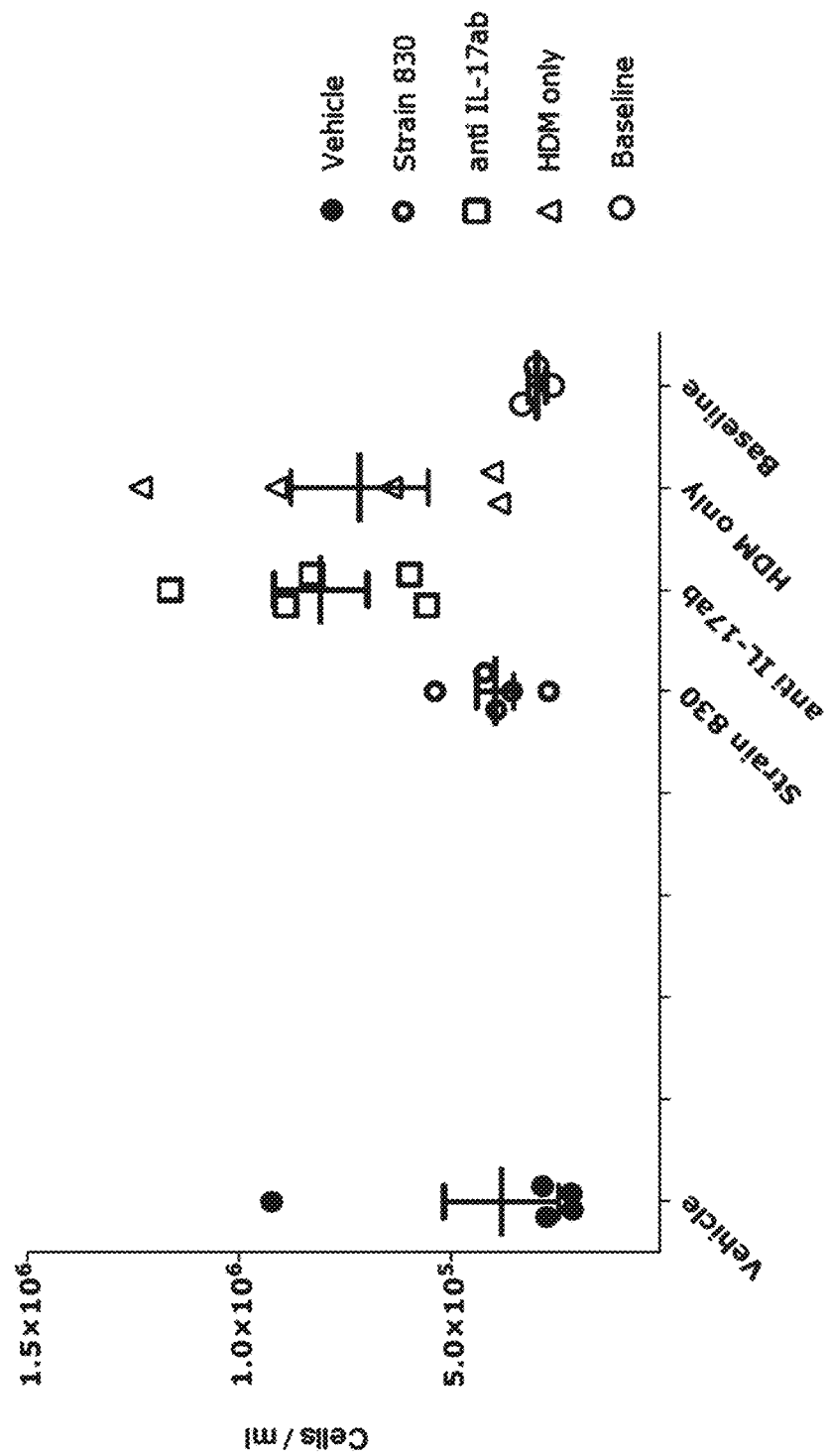
FIG. 13: Mouse model of severe neutrophilic asthma—Total macrophage count in BALF.
Figure 14:
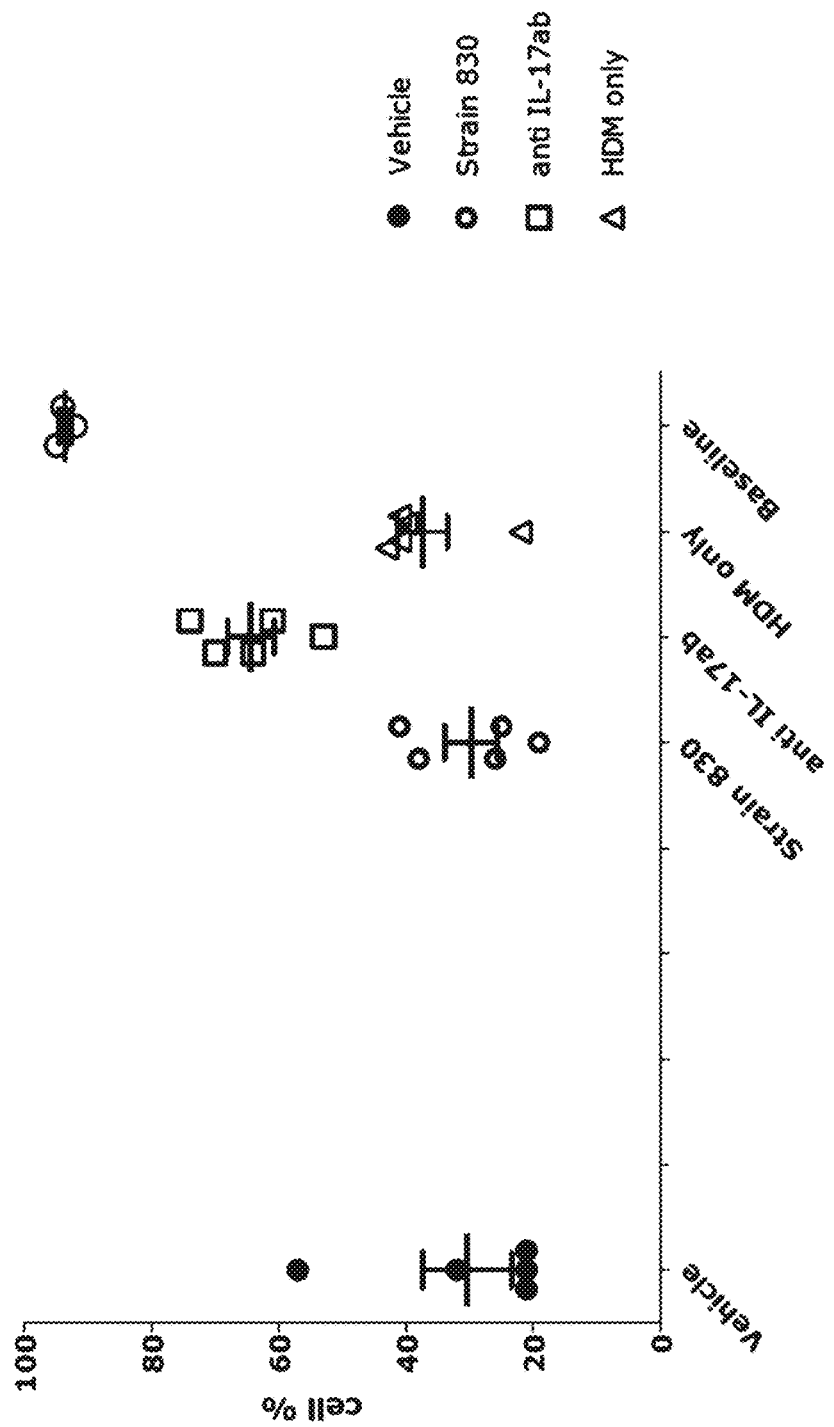
FIG. 14: Mouse model of severe neutrophilic asthma—Proportion of macrophages in BALF.
Figure 15:
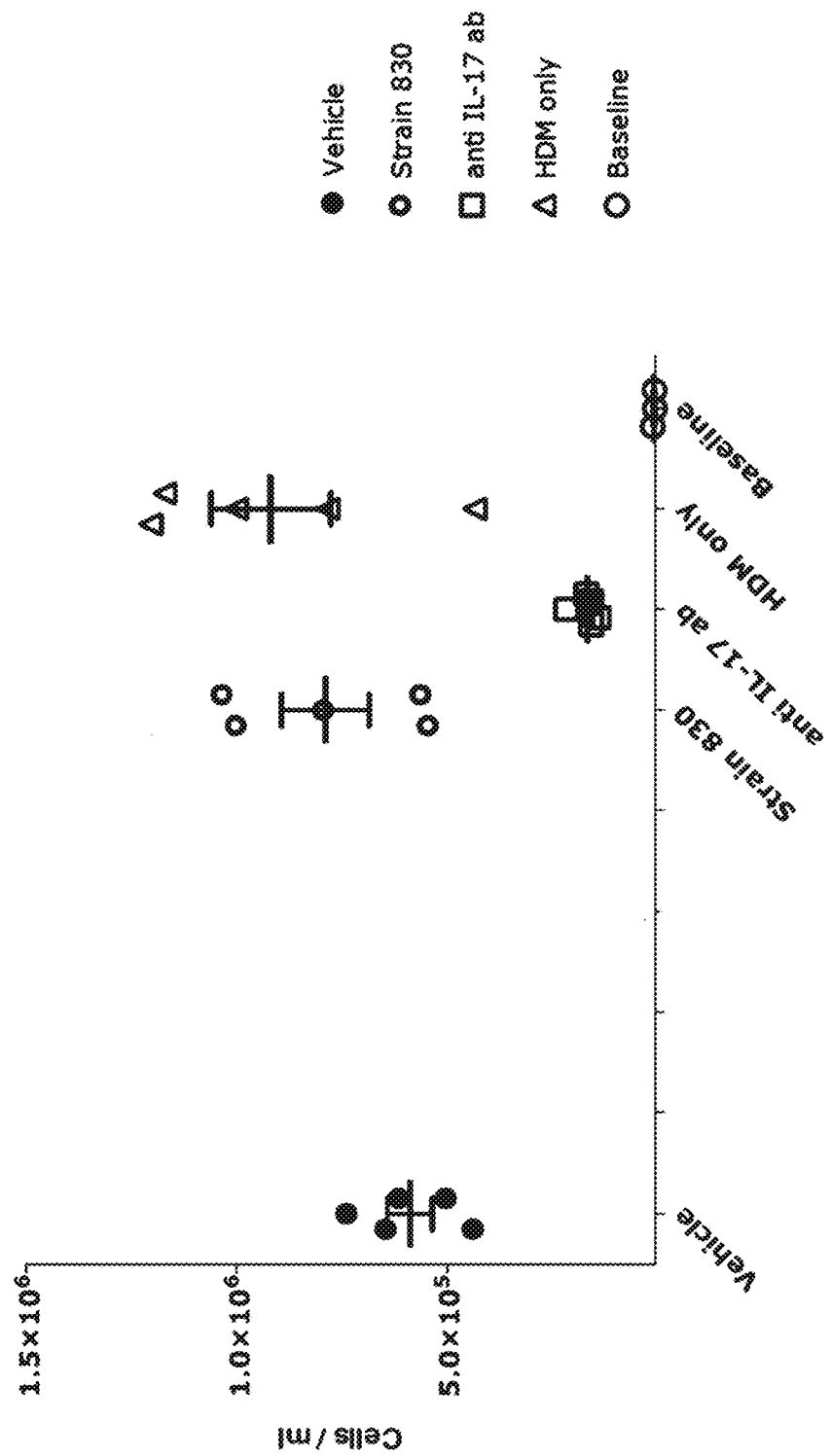
FIG. 15: Mouse model of severe neutrophilic asthma—Total neutrophil count in BALF.
Figure 16:
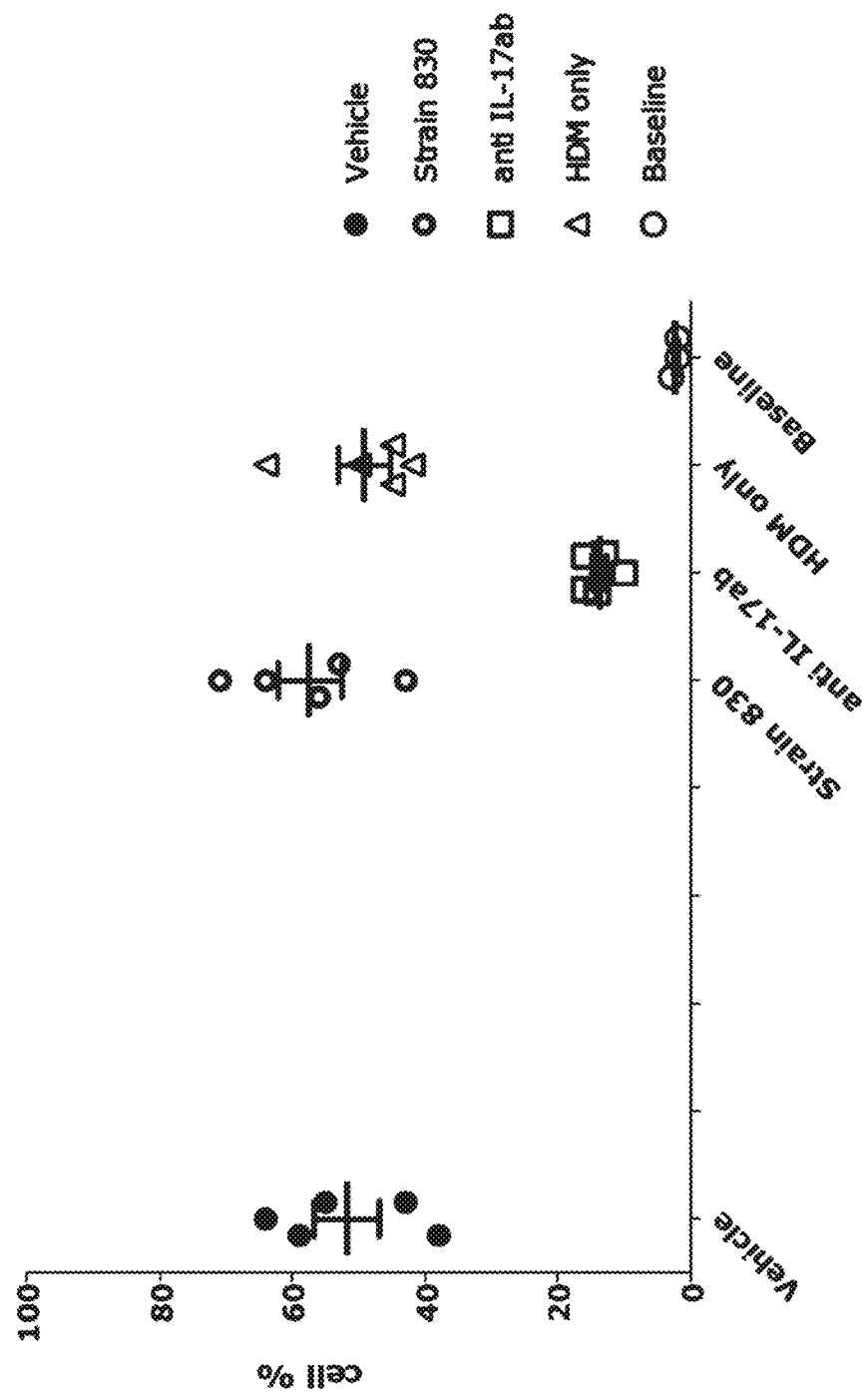
FIG. 16: Mouse model of severe neutrophilic asthma—Proportion of neutrophils in BALF.
Figure 17:
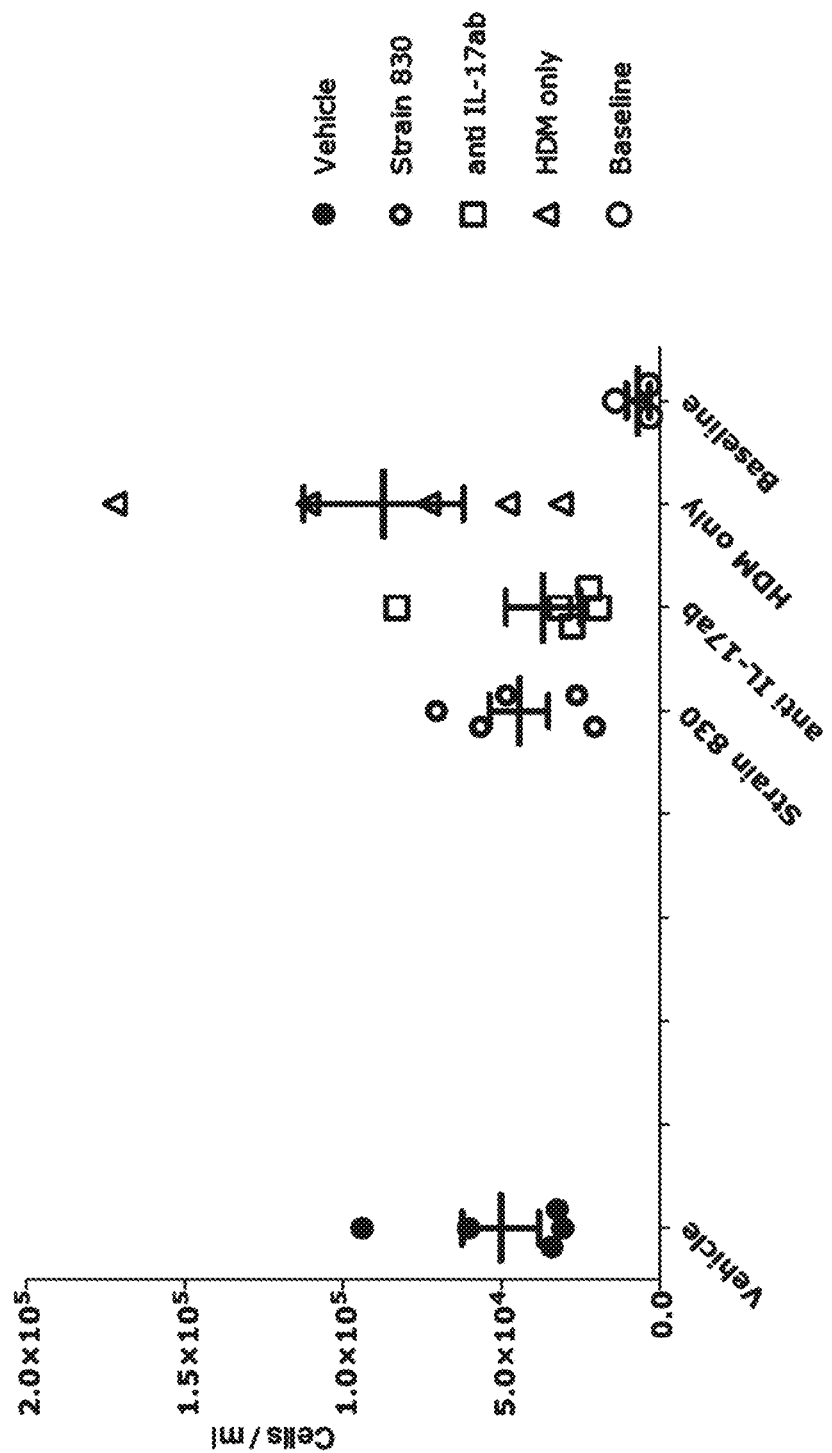
FIG. 17: Mouse model of severe neutrophilic asthma—Total lymphocyte count in BALF.
Figure 18:
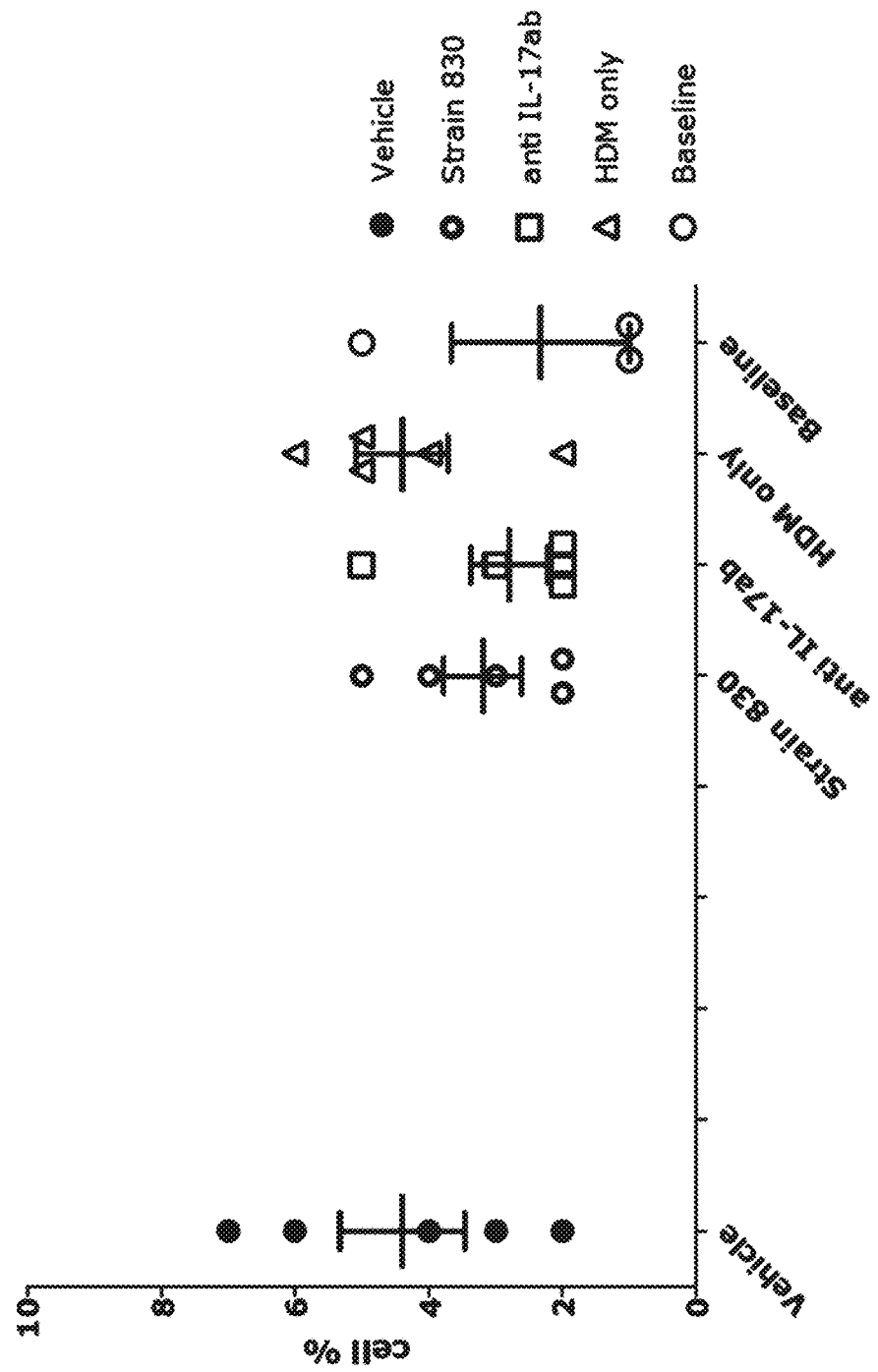
FIG. 18: Mouse model of severe neutrophilic asthma—Proportion of lymphocytes in BALF.

The most important results of this experiment are displayed in FIGS. 6 and 7, which report on the total number and percentage of neutrophils detected in bronchiolar lavage following challenge with HDM. Administration of strain 830 resulted in a reduction in total neutrophils and the proportion of neutrophils in BAL relative to the vehicle-only control.

Example 2—Efficacy of Bacterial Inocula in a Mouse Model of Severe Neutrophilic Asthma Summary Mice were administered with compositions comprising bacterial strains according to the invention and were subsequently sensitised with subcutaneous administrations of house dust mite (HDM) extract and challenged with an intranasal administration of HDM in order to model the inflammatory response of severe neutrophilic asthma. The magnitude and characteristics of the inflammatory response exhibited by mice treated with compositions of the invention were compared to control groups. The compositions of the invention were found to alleviate the inflammatory response, and in particular to reduce recruitment of neutrophils, in a manner comparable to the positive control comprising administrations of anti-IL-17 antibodies. The data therefore indicate that the compositions of the invention may be useful for treating IL-17- and Th17-mediated conditions such as neutrophilia and asthma.

Strain

830: *Blautia* stercoris

Study Design

Groups:

1. Negative control group. Treatment with vehicle control (per oral).
6. Treatment with therapeutic bacteria inoculum strain 830 (per oral).
7. Positive control group. Treatment anti-IL-17 (i.p.).
8. Untreated Control Group.
9: Healthy mice (baseline).

Number of mice per group (Group 1-8)=5

Day −14 to day 17: Daily administration of vehicle control per oral (Group 1).

Day −14 to day 17: Daily administration of therapeutic bacteria inoculum per oral (Group 2-6).

Day 0: Sensitization with HDM in CFA (s.c.) (Group 1-8).

Day 7: Sensitization with HDM in CFA (s.c.) (Group 1-8).

Day 13, 15, 17: Administration of anti IL-17 neutralizing antibody per i.p. (Group 7).

Day 14, 15, 16, 17: Challenge with HDM in 30 ul PBS per nasal (Group 1-8).

Day 18: Sacrifice of all animals for analysis.

Endpoints and Analysis:

On day 14 animals were sacrificed by lethal intraperitoneal injection with pentabarbitol (Streuli Pharma AG, Uznach, Cat: 1170139A) immediately followed by a bronchoalveolar lavage (BAL). Cells were isolated from the BAL fluid and differential cell counts performed (200 cell counts/samples).

Material and Methods.

Mice.

Female 7 week old C57BL/6 mice were purchased from Charles River Laboratories and randomly allocated to cages totally 5 mice per cage (Ventilated cages sourced from Indulab AG, Gams, Switzerland Cage type: "The Sealsafe™—IVC cage. Product number 1248L). Cages were labelled with study number, group number and experimental starting date. Mice were monitored weekly and acclimatized to facility for 7 days prior to initiation of study (Study Day −14). Animals were 8 weeks old on Study Day −14. Potable water and food were available ad libitum. Cage enrichment was present. Daily care of the animals was performed according to local authorization license number 2283.1 (issued and approved by: Service de la consommation et des affaires vétérinaires du Canton de Vaud). Potable water and food were available ad libitum and refreshed once daily. Cage enrichment was present. Animal welfare regulations were observed as given by official authorities of Switzerland under ordinance 455.163 of the FVO (Federal Veterinary Office) on laboratory animal husbandry, production of genetically modified animals, and methods of animal experimentation.

Culturing of Bacteria Inoculum.

Within a sterile workstation, a cryo-vial of bacteria was thawed by warming in gloved hand and ~0.7 ml of contents injected into a Hungate tube (Cat Number, 1020471, Glasgerätebau Ochs, Bovenden-Lenglern, Germany), containing 8 ml of anaerobic YCFA. Two tubes per strain were usually prepared. The Hungate tubes were then incubated (static) at 37° C. for up to 24-26 hours (for strain 830).

Culturing of Vehicle Control.

A Hungate tube containing 8 ml of anaerobic YCFA was incubated (static) at 37° C. for 16 h.

Administration of Bacteria Inoculum or Vehicle Control.

400 ul of cultured bacteria inoculum or vehicle control were administered per day per oral gavage.

HDM Sensitization.

50 μg of HDM (Catalogue number: XPB70D3A25, Lot number: 231897, Greer Laboratories, Lenoir, N.C., USA) in PBS was emulsified in equal volume of complete Freund's adjuvant (CFA Chondrex Inc. Washington, USA) and administered subcutaneously in a volume of 200 twice over two weeks on opposite flanks. A week after the second immunization, mice were anesthetized by i.p. injection with 9.75 mg xylasol and 48.75 mg ketasol per kg (Dr. E. Graeub AG, Bern, Switzerland) and then given intranasal challenges of 15 μg of HDM in a volume of 30 ul PBS on 4 consecutive days. Analysis was performed one day after the final challenge.

Preparation and Administration of Positive Control Compound Anti Mouse IL-17 Antibody.

Anti-IL-17 neutralizing antibody was sourced from Bio X Cell and was stored at 4° C. (Clone 17F3, Cat. Number BE0173, Bio X Cell) and administered per i.p. at a dose of 12.5 mg/kg at days indicated in study protocol above.

Terminal Procedure.

On day 18 animals were sacrificed by lethal i.p. injection with pentabarbitol (Streuli Pharma AG, Uznach, Cat: 1170139A) immediately followed by bronchoalveolar lavage (BAL) in 500 ul of saline.

Measurement of Cellular Infiltrates into BAL.

Cells were isolated from the BAL fluid and differential cell counts were performed based upon standard morphological and cytochemical criteria.

Graphs and Statistical Analysis.

All graphs were generated with Graphpad Prism Version 6 and a one-way ANOVA was applied. Results from the statistical analysis are provided with the individual data tables. Error bars represent Standard Error of the Mean (SEM).

Results and Analysis

The results of the experiment are shown in FIGS. 10-18.

No morbidity or mortality was noted in the mice treated with the bacteria or the vehicle. As shown in FIGS. 11, 12, 15 and 16, certain mice treated with strain 830 exhibited reduced eosinophilia and neutrophilia.

Example 3—Efficacy of Bacterial Inocula to Treat Arthritis in a Type II Collagen-Induced Arthritis Mouse Model Materials and Methods
Strain
830: *Blautia stercoris*
Bacterial Cultures Bacterial cultures were grown up for administration in an anaerobic workstation (Don Whitley Scientific).

Bacterial strain #830 was grown using glycerol stocks. The glycerol stocks were stored at −80° C. Three times per week, glycerol stocks were thawed at room temperature and streaked on YCFA plates. A new glycerol aliquot was used on each occasion. Bacteria were allowed to grow on a given plate for up to 72 hours.

Solutions to be administered to the animals were prepared twice daily with an eight hour interval for morning (AM) and afternoon (PM) treatments. A bacterial colony was picked from the streaked plate and transferred into a tube containing YCFA media. Bacterial strain #830 was allowed to grow for 24 hours before AM administrations. Bacteria were sub-cultured at 1% into YCFA media for PM administrations. OD values were recorded for each strain after morning and afternoon treatment preparations.

Type II Collagen-Induced Arthritis Mouse Model

Adult male DBA/1 mice were randomly allocated to experimental groups and allowed to acclimatise for two weeks. On Day 0, animals were administered by subcutaneous injection with 100 microliters of an emulsion containing 100 micrograms of type II collagen (CII) in incomplete's Freund's adjuvant supplemented with 4 mg/ml *Mycobacterium tuberculosis* H37Ra. On Day 21, animals were administered by subcutaneous injection with a booster emulsion containing 100 μg of type II collagen in incomplete Freund's adjuvant.

Treatments were given according to the administration schedule below. From Day −14 until the end of the experiment on Day 45, animals were weighed three times per week. From Day 21 until the end of the experiment, animals were scored three times per week for clinical signs of arthritis to include swelling of the hind- and front paws, radio-carpal (wrist) joints and tibio-tarsal (ankle) joints.

On Day 45 mice were culled and terminal blood samples were taken for cytokine analysis.

On Day −14, Day 0 and Day 45, faecal samples were collected for microbiological analysis, immediately snap-frozen and stored at −80° C.

The collagen-induced arthritis (CIA) mouse model is a well-established mouse model for rheumatoid arthritis [68]. Immunisation with CII causes a pathogenesis that includes several important pathological features of rheumatoid arthritis, including synovial hyperplasia, mononuclear cell infiltration and cartilage degradation. Significantly, the development of CIA is mediated by Th17 cells through secretion of IL-17A [69]. The immune response underlying the arthritis model is enhanced by the use of Freund's adjuvant supplemented with *Mycobacterium tuberculosis*.

On Day 21, spleens were collected from three satellite animals in each group. Cells were cultured for 72 hours in the presence or absence of type II collagen. Cytokines, including TNF-α, IL-6, IFN-γ, IL-4, IL-10 and IL-17, were quantified in the culture supernatants and in terminal serum by Luminex. Cell proliferation was quantified using a tritiated thymidine incorporation method.

Treatment Groups and Dosages

All Groups were n=15 (n=12 for the main study group and n=3 for satellite groups)

The vehicle used for the biotherapeutics was Yeast extract-Casitone-Fatty Acids (YCFA) medium.

| Group | Dose | Administration Route | Regimen | Disease Induction |
|---|---|---|---|---|
| 1 Vehicle | 5 ml/kg | PO | BID: Day-14-End | Day 0: Collagen/CFA, once, SC Day 21: Collagen/IFA, once, SC |
| 3 Biotherapeutic #830 | 5 ml/kg | | | |

PO: oral gavage,
SC: subcutaneous injection,
BID: twice a day,
CFA: complete Freund's adjuvant.

Bodyweights

From Day −14 until the end of the experiment, animals were weighed three times per week. Data were graphed (Mean±SEM).

Non-Specific Clinical Observations

From Day −14 until the end of the experiment, animals were checked daily for non-specific clinical signs to include abnormal posture (hunched), abnormal coat condition (pilo-erection) and abnormal activity levels (reduced or increased activity).

Clinical Observations

From Day 21 until the end of the experiment on Day 45, animals were scored three times per week for clinical signs of arthritis to include swelling of the hind- and front paws, radio-carpal (wrist) joints and tibio-tarsal (ankle) joints. Each limb was scored using the following scale: (0) normal, (1) slight swelling, (2) mild swelling, (3) moderate swelling and (4) severe swelling. A clinical score was calculated by adding each limb score. The maximum possible clinical score for an animal was (16). Animals with a score equal to (12) on two consecutive occasions and animals with a score greater than (12) on any one occasion were culled. Data were graphed (Mean±SEM).

Cell Proliferation Analysis

On Day 21, three satellite animals per group were culled and spleens were dissected out. Spleen cells were cultured for 72 hours in presence or absence of type II Collagen. After 72 hours, cells were pulsed overnight in the presence of tritiated thymidine. Cell proliferation was quantified by measuring thymidine incorporation. Data were graphed (Mean±SEM). Supernatants were taken and tested for the presence of key cytokines.

Cytokine Analysis

Terminal supernatants from the spleen cell cultures were tested in order to quantitate TNF-α, IL-6, IFN-γ, IL-4, IL-10 and IL-17 by Luminex. Data were graphed (Mean±SEM).

Microbiological Analysis

On Day −14, Day 0 and Day 45, faecal samples were collected from each animal, immediately snap-frozen, and stored at −80° C. Caeca (including content) were immediately snap-frozen and stored at −80° C. A bacterial identification test was performed daily by plating the bacteria.

Histopathology

At the end of the experiment, hind paws were stored in tissue fixative. Samples were transferred into decalcification solution. Tissue samples were processed, sectioned and stained with Haematoxylin & Eosin. Sections were scored by a qualified histopathologist, blind to the experimental design, for signs of arthritis to include inflammation, articular cartilage damage and damage to the underlying metaphyseal bone. A detailed scoring system was used (see below). Data were graphed (Mean±SEM). Raw and analysed data were provided as well as representative pictures.

TABLE 1

| Histopathology Scoring System | |
|---|---|
| Grade | Description |
| | Inflammation |
| 0 | Normal joint |
| 1 | Mild synovial hyperplasia with inflammation dominated by neutrophils. Low numbers of neutrophils and macrophages in joint space. |
| 2 | Synovial hyperplasia with moderate to marked inflammation involving both neutrophils and macrophages. Neutrophils and macrophages in joint space; may be some necrotic tissue debris. |
| 3 | Synovial hyperplasia with marked inflammation involving both neutrophils and macrophages. Loss of synoviocyte lining. Inflammation may extend from synovium to surrounding tissue including muscle. Numerous neutrophils and macrophages in joint space, together with significant necrotic tissue debris. |
| | Articular cartilage damage |
| 0 | Normal joint |
| 1 | Articular cartilage shows only mild degenerative change. Early pannus formation may be present peripherally. |
| 2 | Articular cartilage shows moderate degenerative change and focal loss. Pannus formation is present focally. |
| 3 | Significant disruption and loss of articular cartilage with extensive pannus formation. |
| | Damage to the underlying metaphyseal bone |
| 0 | Normal joint |
| 1 | No change to underlying metaphyseal bone. |
| 2 | May be focal necrosis or fibrosis of metaphyseal bone. |

TABLE 1-continued

Histopathology Scoring System

| Grade | Description |
|---|---|
| 3 | Disruption or collapse of metaphyseal bone. Extensive inflammation, necrosis or fibrosis extending to medullary space of the metaphysis. |

Results and Analysis

Survival and Non-Specific Clinical Observations

Some animals were culled prior to the scheduled end of the study due to the severity of the clinical signs of arthritis or due to the severity of the non-specific clinical observations.

One animal in Group 1 (vehicle-treated) was culled during the pre-treatment period (Day −14 to Day 0—animal arrived from supplier with broken leg).

Seven animals were culled due to the severity of the clinical signs of arthritis: five animals in Group 1 (vehicle-treated) and two animals in Group 3 (biotherapeutic #830-treated).

Six animals were culled due to the severity of the non-specific clinical signs including abnormal posture (hunched), abnormal coat condition (piloerection), abnormal activity levels (reduced activity): three animals in Group 1 (vehicle-treated) and three animals in Group 3 (biotherapeutic #830-treated).

Bodyweights

Figure 19:
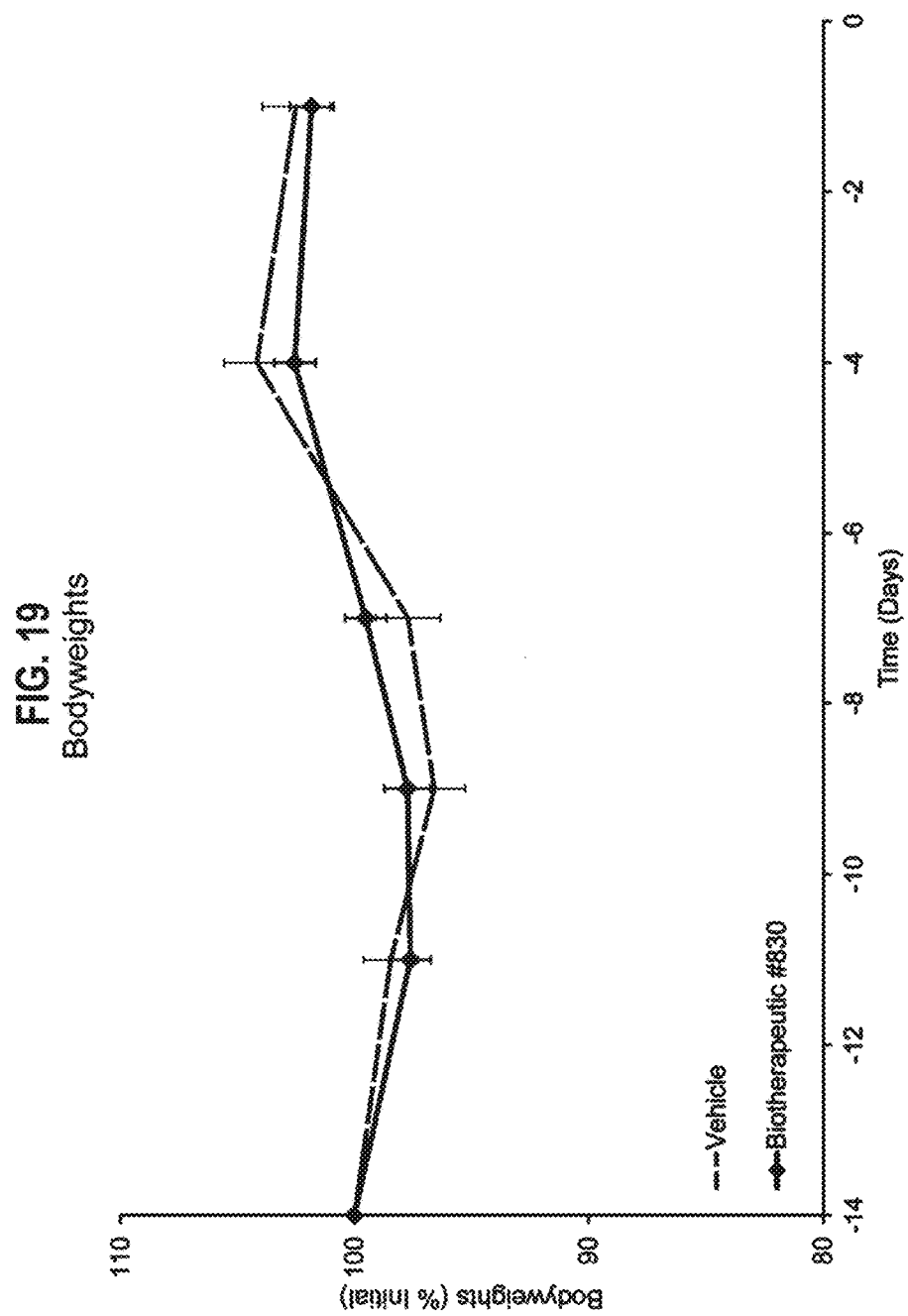
FIG. 19: Mouse model of rheumatoid arthritis—Bodyweights, days −14 to 0. Data are presented as Mean±SEM percentages of the initial (Day −14) bodyweights.

Bodyweight data recorded from Day −14 until Day 0 and expressed as a percentage of the initial (Day −14) bodyweights were analysed by two-way ANOVA followed by Dunnett's post-test for multiple comparisons with Day −14 then for multiple comparison with the vehicle-treated group. The data are presented in FIG. 19. Data from animals culled prior to the scheduled end of the experiment were excluded from the analyses.

When compared to Day −14, twice daily administrations by oral gavage induced a significant bodyweight loss in the vehicle-treated group on Day −9 and Day −7 and in Group 3 (biotherapeutic #830-treated) on Day −11 and Day −9.

Figure 20:
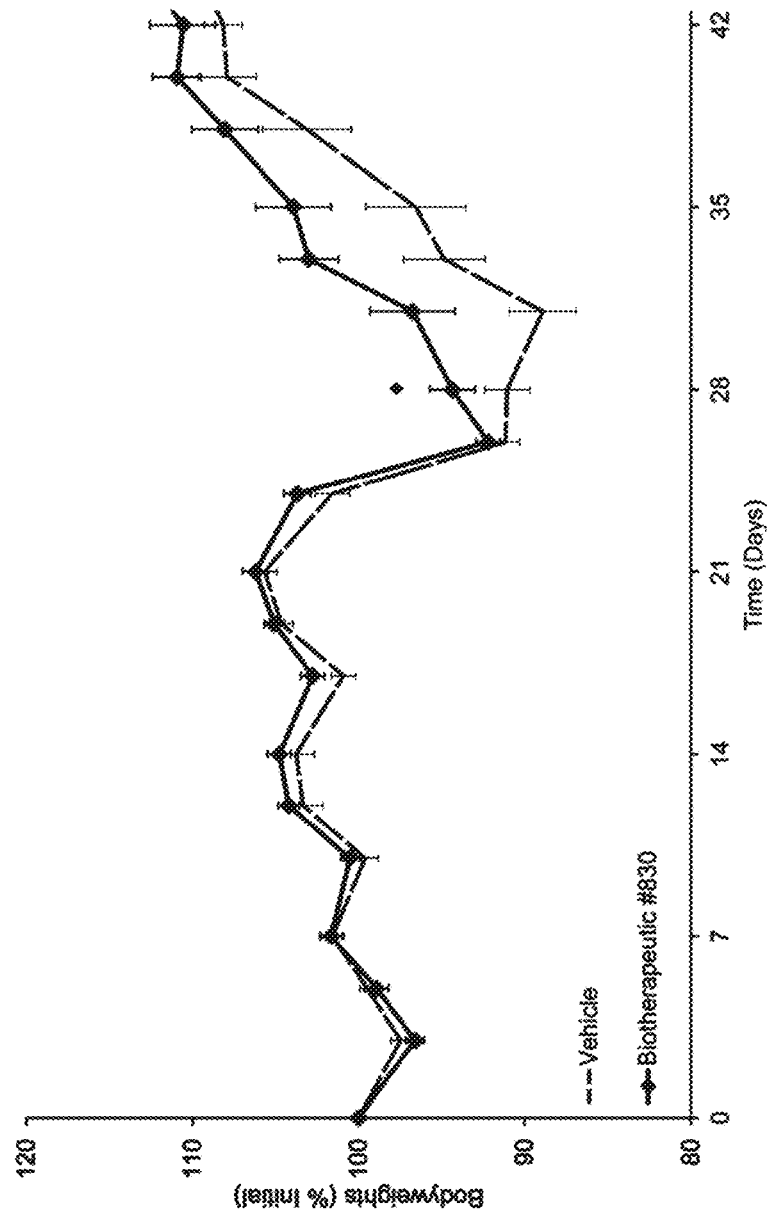
FIG. 20: Mouse model of rheumatoid arthritis—Bodyweights, days 0 to 42. Data are presented as Mean±SEM percentages of the initial (Day 0) bodyweights. ♦ $p<0.05$ when compared to the vehicle-treated group.

Bodyweight data recorded from Day 0 until Day 28 and expressed as a percentage of the initial (Day 0) bodyweights were analysed by two-way ANOVA followed by Dunnett's post-test for multiple comparisons with Day 0 in the Vehicle group then for multiple comparison with the vehicle-treated group. The data are presented in FIG. 20. Data from animals culled prior to the scheduled end of the experiment and from Satellite animals were excluded from the analyses. Day 28, Day 35 and Day 42 data were further analysed by one-way ANOVA followed by Dunnett's post-test for multiple comparisons to the vehicle-treated group.

The onset of clinical signs of arthritis was associated with a significant bodyweight loss on Day 26 and Day 28 ($p<0.0001$) when compared to Day 0 in the vehicle-treated group.

When compared to the vehicle-treated group, the bodyweights were significantly higher in Group 3 (biotherapeutic 4830) treated on Day 28 ($<0.005$).

Clinical Observations

Figure 21:
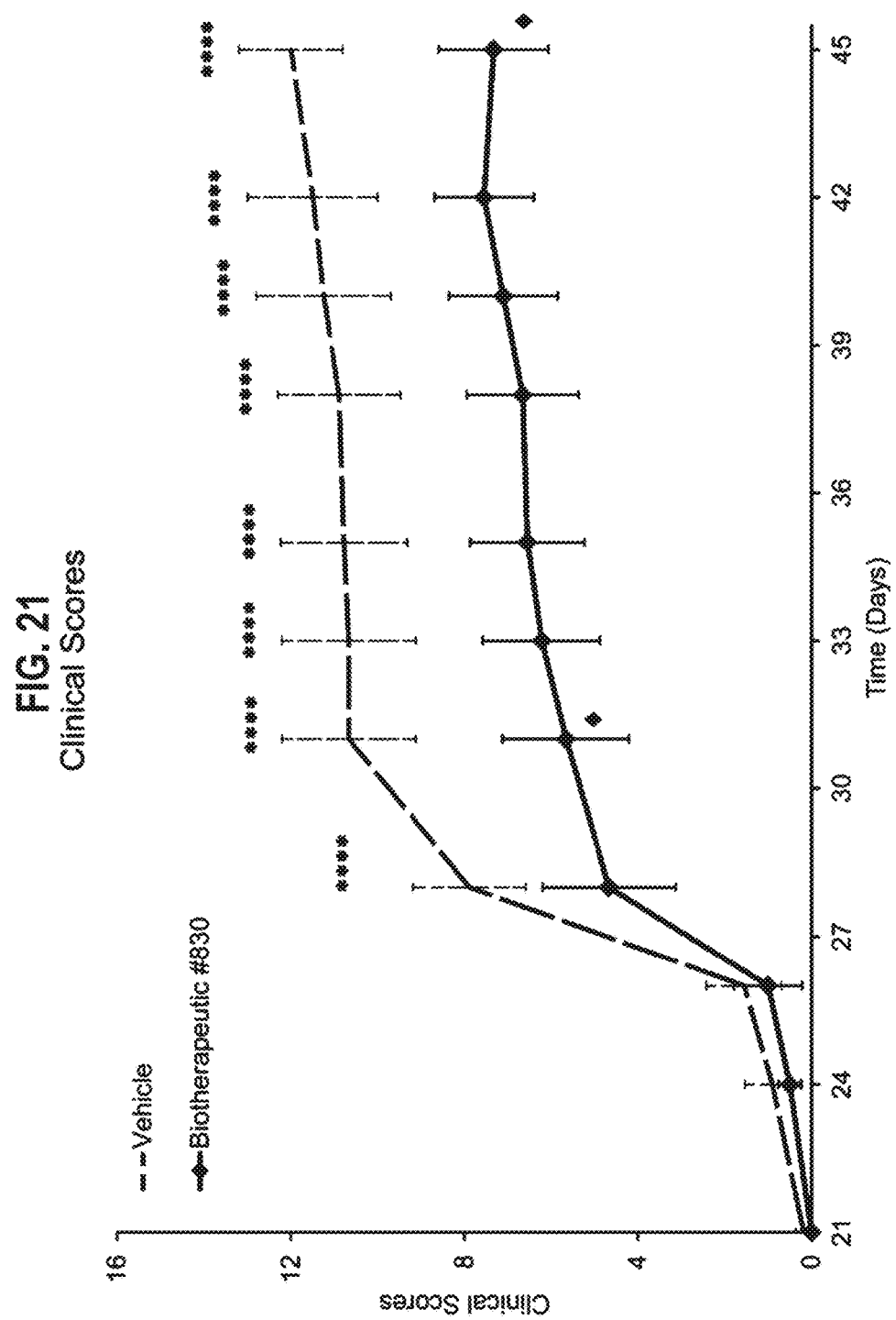
FIG. 21: Mouse model of rheumatoid arthritis—Clinical Scores. Data are presented as Mean±SEM. ****$p<0.0001$ when compared to Day 21 in the vehicle-treated group. ♦ $p<0.05$ when compared to the vehicle-treated group on a given day.

Clinical score data were analysed by two-way ANOVA followed by Dunnett's post-test for multiple comparisons between days in the vehicle-treated group then for multiple comparisons between experimental groups and the vehicle-treated group each day. The data are presented in FIG. 21. Data recorded from animals culled prior to the end of the experiment were excluded from the analysis. When animals were culled due to the severity of the clinical signs of arthritis, the last recorded score was reported for the following days and used in the statistical analyses.

A significant increase of the clinical scores was observed in the vehicle-treated group from Day 28 until Day 45 ($p<0.0001$) when compared to Day 21.

Biotherapeutic #830 induced a reduction of the clinical scores when compared to the vehicle-treated group from Day 28 until Day 45. The reduction was statistically significant on Day 31 and Day 45 ($p<0.05$).

Cell Proliferation Analysis

To validate the assay, splenocytes were cultured in the presence of soluble anti-CD3 and anti-CD28 (anti-CD3/CD28) as positive control stimuli to confirm the proliferative potential of the cells.

Strong proliferative responses to anti-CD3/CD28 were seen in all experimental groups, showing cells were healthy, viable and able to respond to activation signals.

Figure 22:
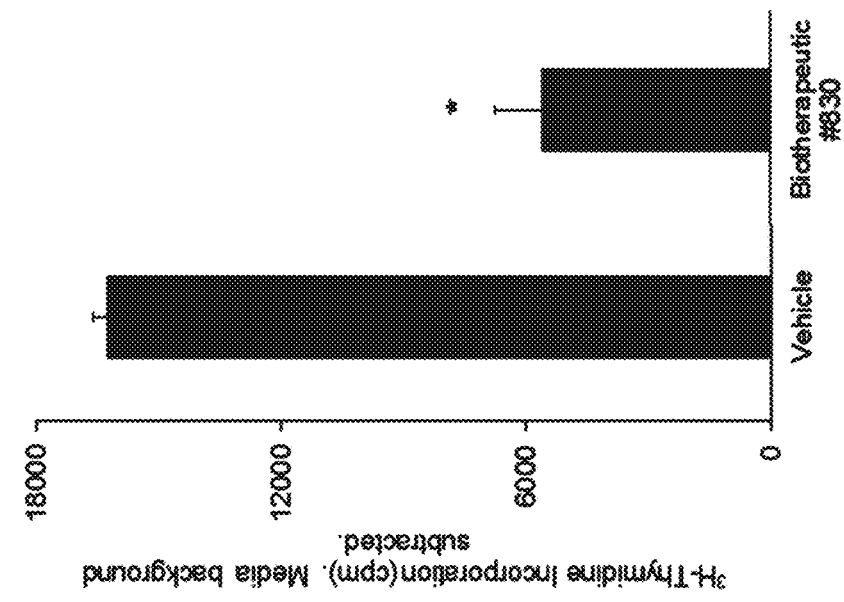
FIG. 22: Mouse model of rheumatoid arthritis—Splenocyte proliferative response to Collagen II. Media background subtracted [CII-stimulated—media background] counts per minute based on 3H-TdR incorporation. All data are presented as Mean±SEM. *$p<0.05$ compared to Vehicle group.

To test the proliferative response in presence of Collagen II (CII), splenocytes were cultured in the presence of CII at 50 µg/ml. Splenocyte proliferative response to CII were analysed by two-way ANOVA followed by Sydak's post-test for multiple comparisons between unstimulated and CII-stimulated splenocytes and one-way ANOVA followed by Dunnett's post-test for comparison of CII-stimulated response in different experimental groups with the vehicle-treated group. The data are presented in FIG. 22.

CII induced a highly significant increase of $^3$H-thymidine incorporation (cpm) when compared to the unstimulated splenocytes in the vehicle-treated group ($p<0.0001$).

The groups treated with biotherapeutic #830 demonstrated significantly lower levels of CII-induced splenocyte proliferation than the vehicle-treated group.

Cytokine Levels in Tissue Culture Supernatants

Levels of each cytokine were measured in tissue culture supernatants derived from anti-CD3/CD28 stimulated cultures by luminex analysis. These showed robust responses for all cytokines measured (mean levels in vehicle group were as follows: IL-4=6,406 pg/ml; IL-6=306 pg/ml; IL-10=10,987 pg/ml; IL-17A=11,447 pg/ml; IFN-γ=15,581 pg/ml; TNF-α=76 pg/ml).

The following sections summarise the data obtained from the Collagen II-stimulated cultures. Where applicable, statistical analyses of the differences between cytokine levels in supernatants of unstimulated and CII-stimulated splenocytes were conducted using two-way ANOVA followed by Sidak's post-test for multiple comparisons, while one-way ANOVA followed by Dunnett's post-test was used for comparison of CII-stimulated response in biotherapeutic-treated groups with the vehicle-treated group. There was no significant difference in cytokine levels between the groups in both cases. This is likely due to the small sample size used (n=3).

In order to more accurately present the distribution of the data for the cytokines with substantial spread of the data, these are presented as scatter plots.

The group means of IL-4 in tissue culture supernatants after stimulation with CII were <5 pg/ml. These are not considered biologically significant and not included here. The group means of TNF-α in tissue culture supernatants after stimulation with collagen were below limit of quantitation.

Figure 23:
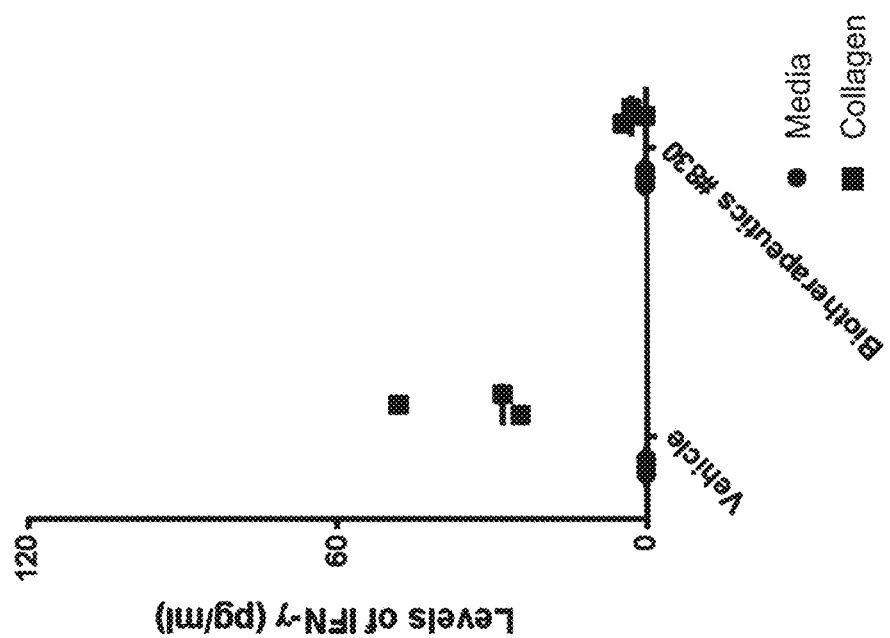
FIG. 23: Mouse model of rheumatoid arthritis—Levels of IFNγ in tissue culture supernatants. Lines represent group median values.

Supernatant Levels of IFN-γ (FIG. 23)

Along with IL-17, IFN-γ is the major cytokine driving disease in the CIA model. The scatter plot in FIG. 23 demonstrates IFN-γ levels after CII stimulation, with group median being higher for the Vehicle-treated group compared to the biotherapeutic.

Figure 24:
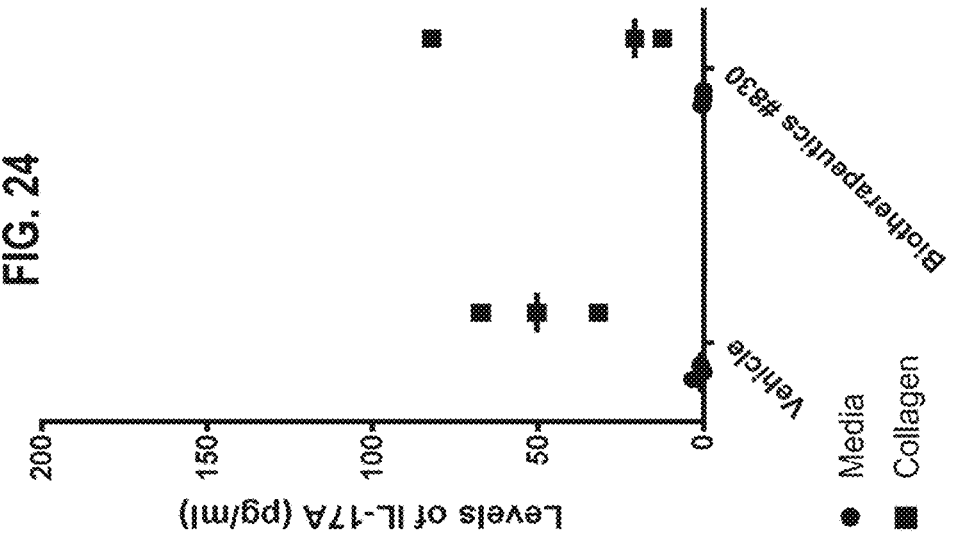
FIG. 24: Mouse model of rheumatoid arthritis—Levels of IL-17A in tissue culture supernatants. Lines represent group median values.

Supernatant Levels of IL-17A (FIG. 24)

Levels of IL-17A were 50 pg/ml in CII-stimulated cultures for the Vehicle-treated group. The levels of this cytokine appeared to be lower in the biotherapeutic group compared to the Vehicle-treated.

Figure 25:
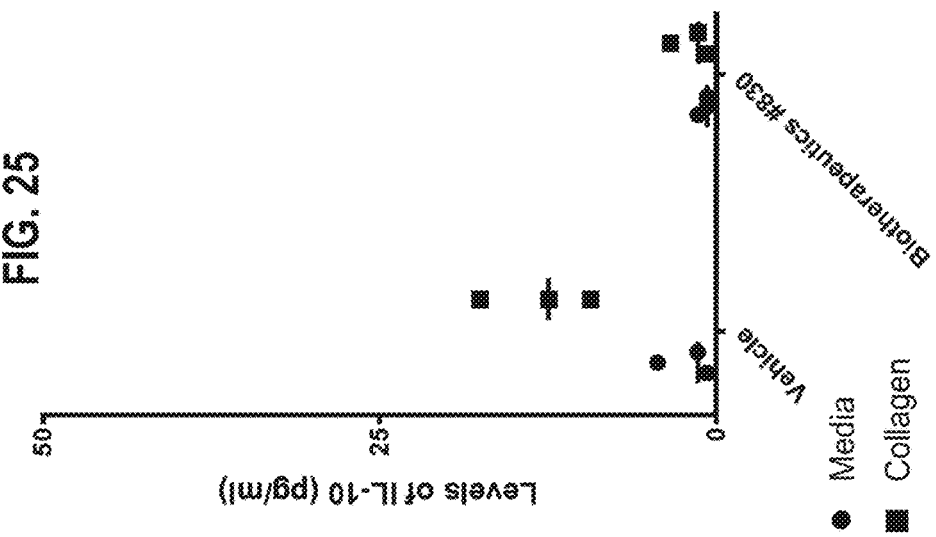
FIG. 25: Mouse model of rheumatoid arthritis—Levels of IL-10 in tissue culture supernatants. Lines represent group median values.

Supernatant Levels of IL-10 (FIG. 25)

Levels of IL-10 in Vehicle-treated group were 13 pg/ml and 2.1 pg/ml for CII-stimulated, and media control cultures, respectively. Higher levels of IL-10 (which is an anti-inflammatory cytokine) for the vehicle-treated group may be expected because inflammation and pro-inflammatory cytokine induction could be accompanied by an anti-inflammatory feedback mechanism.

Figure 26:
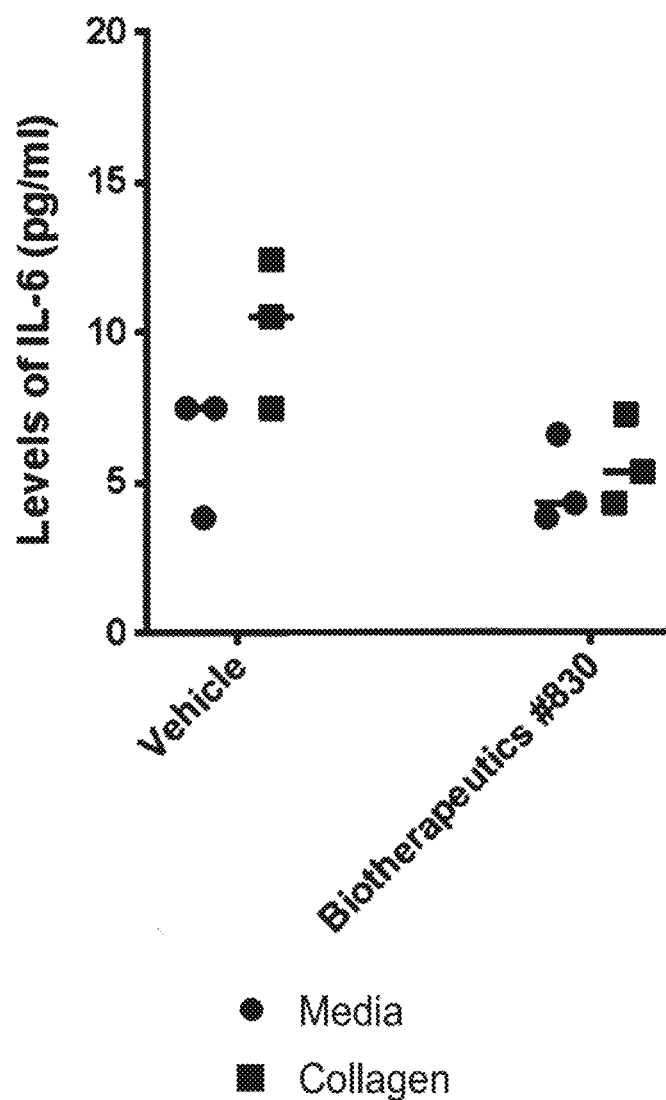
FIG. 26: Mouse model of rheumatoid arthritis—Levels of IL-6 in tissue culture supernatants. Lines represent group median values.
Figure 27:
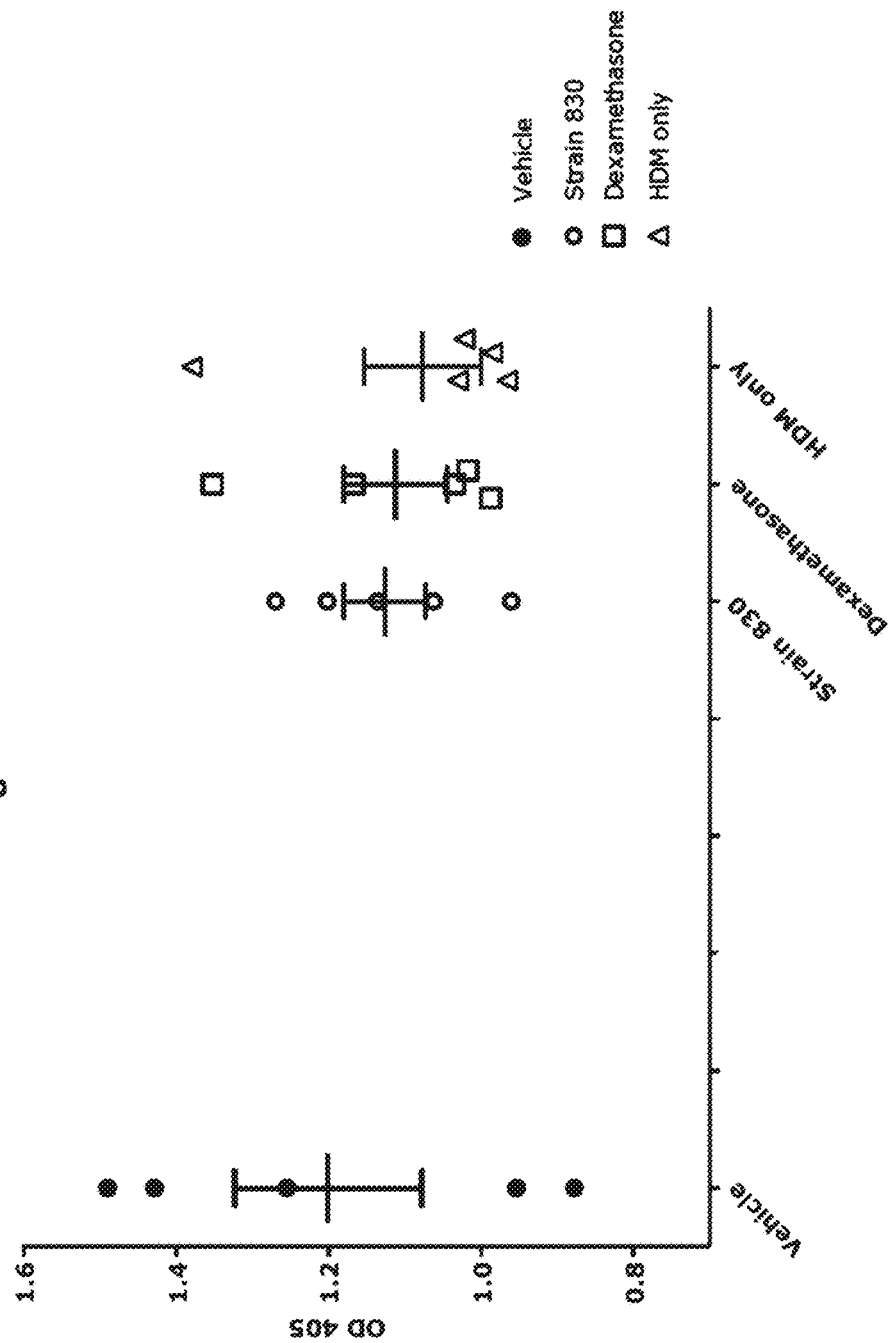
FIG. 27: Mouse model of house dust mite-induced asthma—Total IgE in Serum
Figure 28:
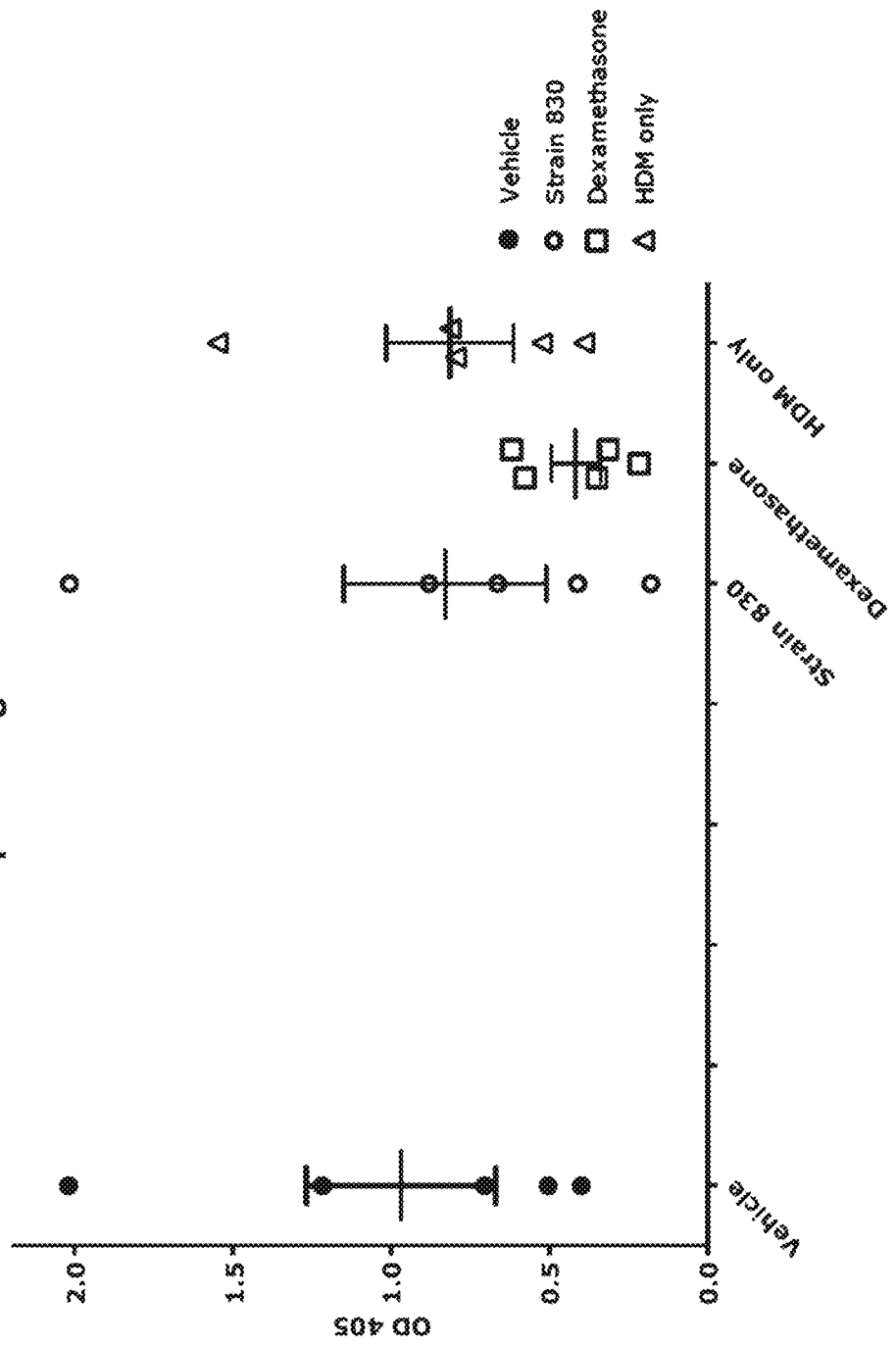
FIG. 28: Mouse model of house dust mite-induced asthma—HDM specific IgG1 in Serum
Figure 29:
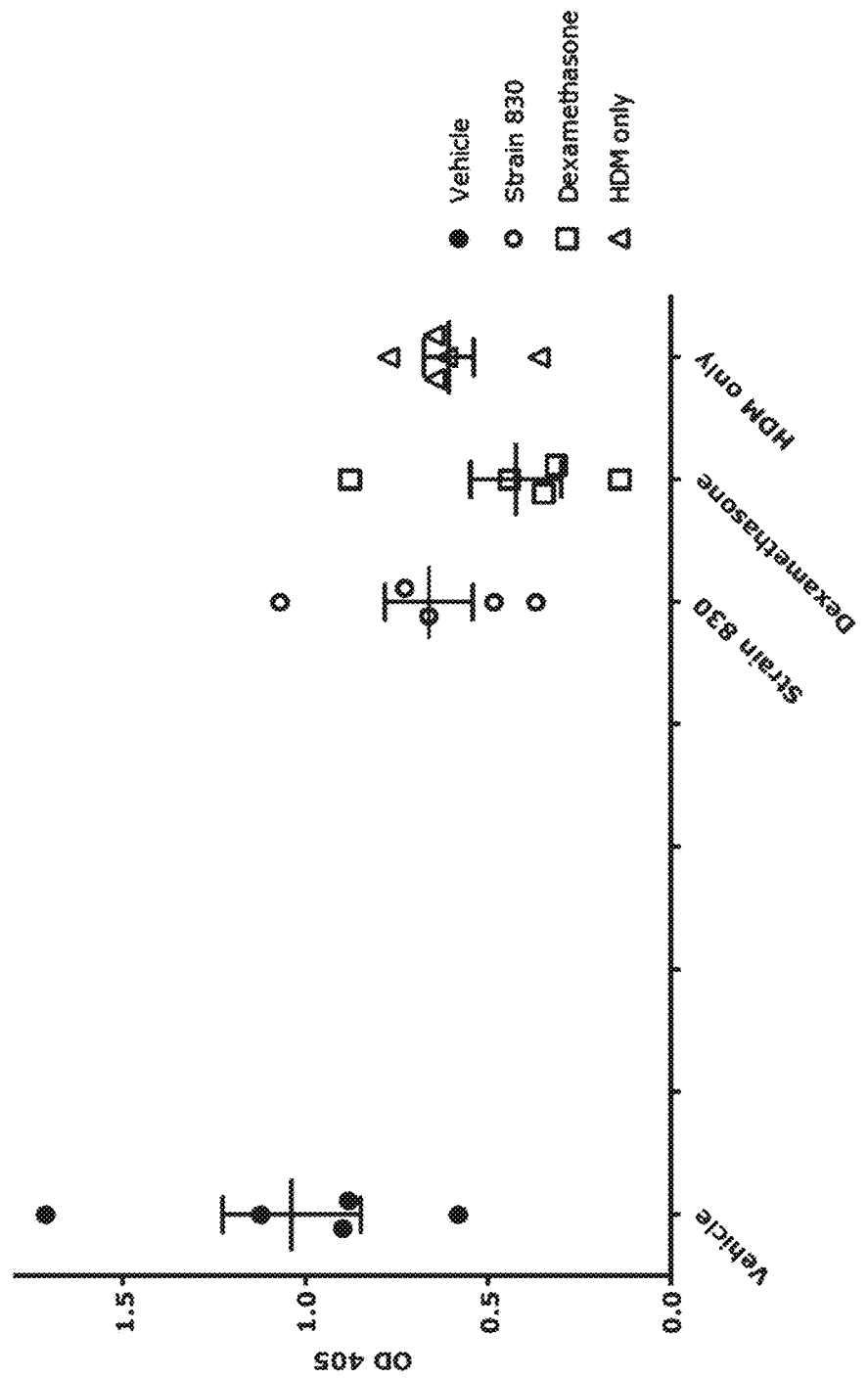
FIG. 29: Mouse model of house dust mite-induced asthma—Total IgE in BALF
Figure 30:
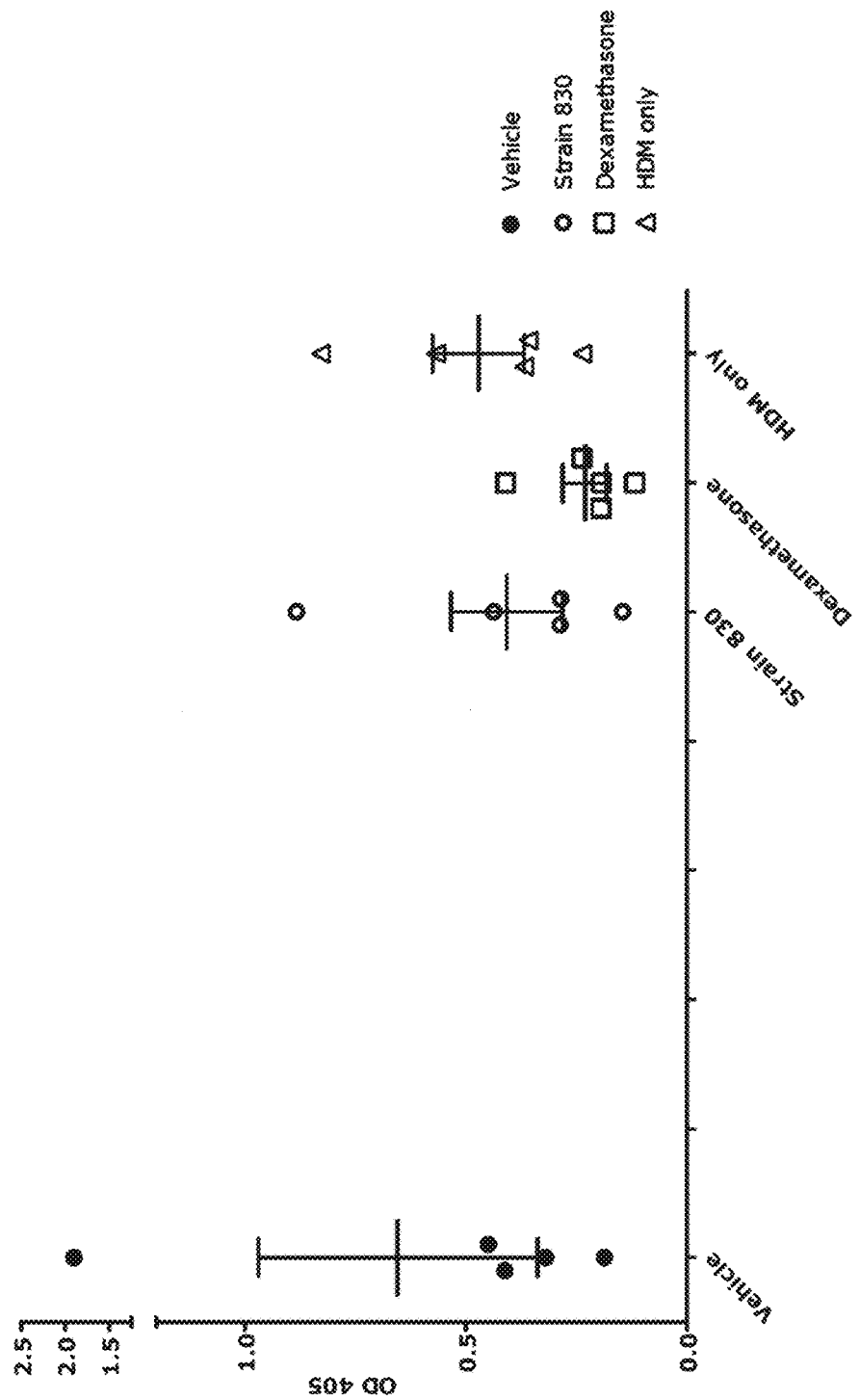
FIG. 30: Mouse model of house dust mite-induced asthma—HDM specific IgG1 in BALF

Supernatant Levels of IL-6 (FIG. 26)

Inflammatory cytokines such as IL-6 and TNF-α are not typically produced at high levels in anti-CII cultures. However, their levels may be altered as a result of immune modulation. Levels of IL-6 in CII-stimulated cultures were modest, reaching 10 pg/ml. Although higher than in media control cultures, these differences were too small to provide rationale for performing statistical analyses.

Microbiological Analysis

Bacterial growth was confirmed by measuring the optical density at 600 nm using a spectrophotometer. Bacterial identity was confirmed by comparing streaked plate pictures to reference pictures.

Following the improved bacterial preparation method, consistently high doses of bacterial strain were administered from Day −2 and Day −3 as indicated by the high OD values measured.

Faecal samples were collected and snap-frozen on Day −14, Day 0 and at termination.

Histopathology

The histopathology results are shown in FIGS. 65-69. As expected for this model, intra-individual and inter-individual variability was observed in terms of the presence/absence of arthritis or the severity of change present.

The nature of the pathology was as expected for this model, with extensive mixed chronic-active inflammation of the synovium and bursa extending to involve the peri-articular soft tissues (muscle, adipose tissue, dermal collagen). In the most severely affected joints there was articular cartilage degeneration and loss with intra-articular debris and inflammation and disruption of the joint and bone structure by fibrosis and inflammation.

The incidence of histopathological changes was: vehicle—80% (16/20); Biotherapeutic #830—20% (4/20). Treatment with Biotherapeutic #830 reduced the incidence of histopathological scores in mouse hind limbs when compared to the vehicle-treated group (see FIGS. 65-68). Histopathology scores were analysed by one-way ANOVA for non-parametric data (Kruskal-Wallis test) followed by Dunn's post-test for multiple comparisons to the vehicle-treated group. Biotherapeutic #830 induced a significant reduction of the joint inflammation scores observed in histopathology when compared to the vehicle-treated group (p<0.01). Biotherapeutic #830 induced a significant reduction of the cartilage damage scores observed in histopathology when compared to the vehicle-treated group (p<0.001). Biotherapeutic #830 induced a significant reduction of the bone damage scores observed in histopathology when compared to the vehicle-treated group (p<0.001). Biotherapeutic #830 induced a significant reduction of the total histopathology scores when compared to the vehicle-treated group (p<0.001).

Summary

Increased clinical scores were observed from Day 28 after the first administration of type II collagen, as expected in this model of arthritis in DBA/1 mice. Biotherapeutic #830 was shown to be effective at treating arthritis in this model. Biotherapeutic #830 was effective for reducing the severity of the clinical scores and for reducing pathological disease in the joints, as demonstrated in the histopathological analysis.

Proliferative recall responses to Collagen II were seen in splenocyte cultures from all experimental groups. The collagen-specific response was significantly reduced following treatment with biotherapeutic #830 (Group 3).

Most of the T cell cytokines tested showed detectable increases between Collagen II-stimulated and media controls in the Vehicle-treated group. These increases were not as obvious in the biotherapeutic-treated group. This broadly supports the proliferative recall responses to Collagen II described above.

There was evidence of suppression of the Th1/Th17 axis, which is the pathogenic response in this model and in human RA. Correlation of reduced levels of cytokines with reduced proliferation is suggestive of immune modulation. There was no evidence that this modulation resulted either from enhanced levels of Th2 associated IL-4 or with increases in the immune modulating cytokine, IL-10.

Example 4—Further Analysis of the Effect of Bacterial Inocula in the Mouse Model of House Dust Mite-Induced Asthma The mice tested in Example 1 were subjected to further analyses to further characterise the effect of the compositions of the invention on the allergic asthma inflammatory response.

Materials and Methods

Blood Withdrawal and Serum Preparation on Day 14.

Blood samples of animals were collected via cardiac puncture. Serum was isolated from the blood sample by centrifugation for 5 min at 14000 g and stored at −20° C.

Organ Removal on Day 14.

Collection of the left lung lobe in formalin for follow-on histological analysis. Collection of the right lung lobes (all remaining lobes) and removal of serum for snap freezing and follow-on analysis. Remaining BAL fluid was snap frozen for follow-on analysis.

Measurement of Antibody Levels in Serum and BAL Fluid

Total IgE and house-dust-mite (HDM) specific IgG1 antibody production were measured in the BAL and serum by ELISA assay.

Isolation of Lung and Histological Analysis

Left lung lobes were fixed in formalin followed by embedment in paraffin, sectioning, and staining with hematoxylin and eosin and PAS. Subsequent histological scoring was performed blinded as followed: Five random fields of view per sample were scored for inflammation (peribronchial infiltration and perivascular infiltration) and mucus production. Inflammatory infiltration was scored with the following grading system:

0—normal
1—mild inflammatory infiltrates
2—moderate inflammatory infiltrates
3—marked inflammatory infiltrates
4—severe inflammatory infiltrates
5—very severe inflammatory infiltrates In each field of view, airways were measured in size and mucus cell numbers were quantified/um.

Measurement of Inflammatory Mediators in Lung Tissue

Right lung lobes (all remaining lobes) isolated for quantification of inflammatory mediators were snap frozen for subsequent measurement of CCL11, IFN-gamma, IL-1 alpha, IL-1 beta, IL-4, IL-5, IL-9, IL-17A, CXCL1, CCL3, CXCL2 and CCL5 by commercially available multiplex assay (Merck-Millipore). Analysis was performed according to the manufacturer's instructions.

Results and Analysis

The results of the experiments are shown in FIGS. 27-45.

Figure 31:
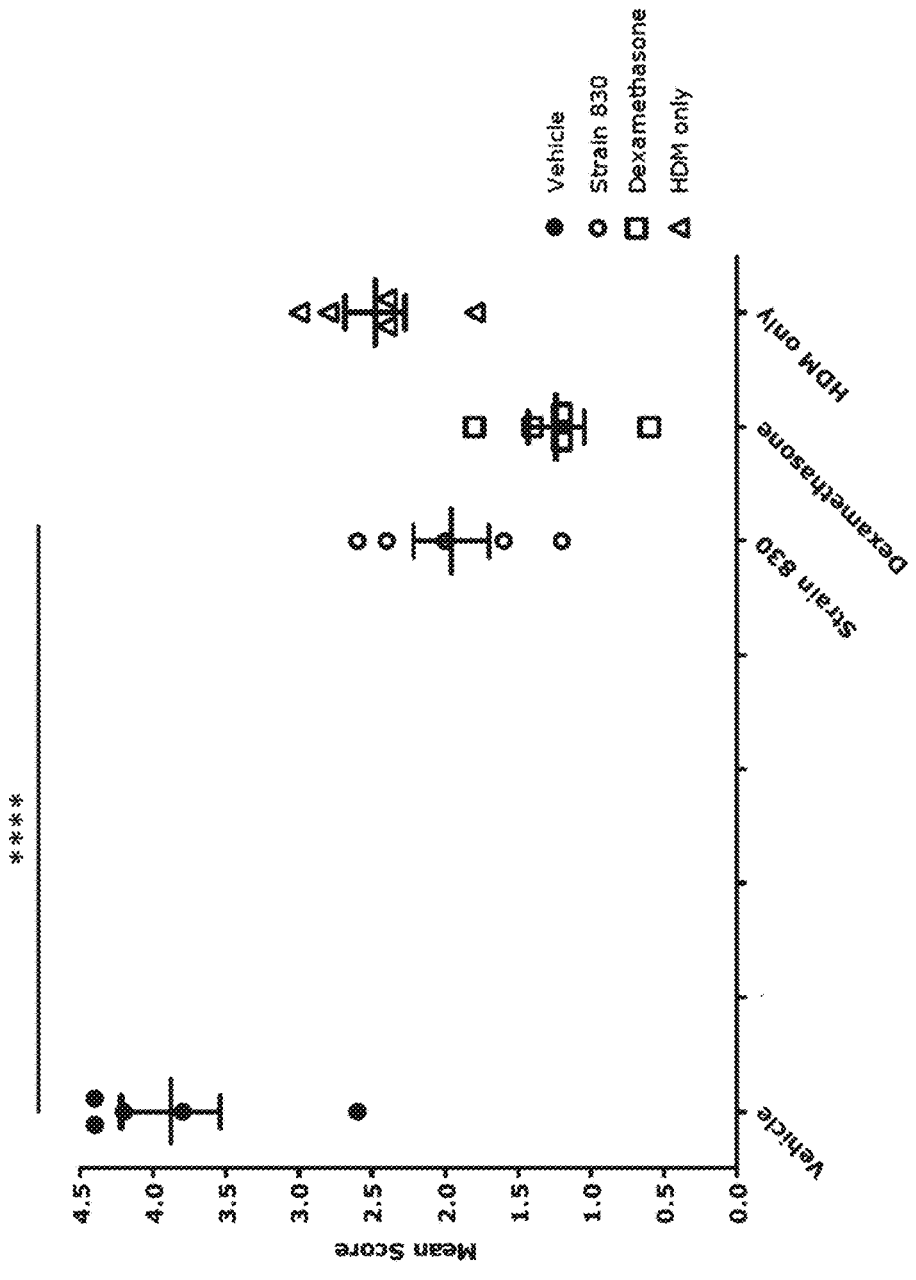
FIG. 31: Mouse model of house dust mite-induced asthma—Histological Analysis—Mean Peribronchiolar Infiltration Score
Figure 32:
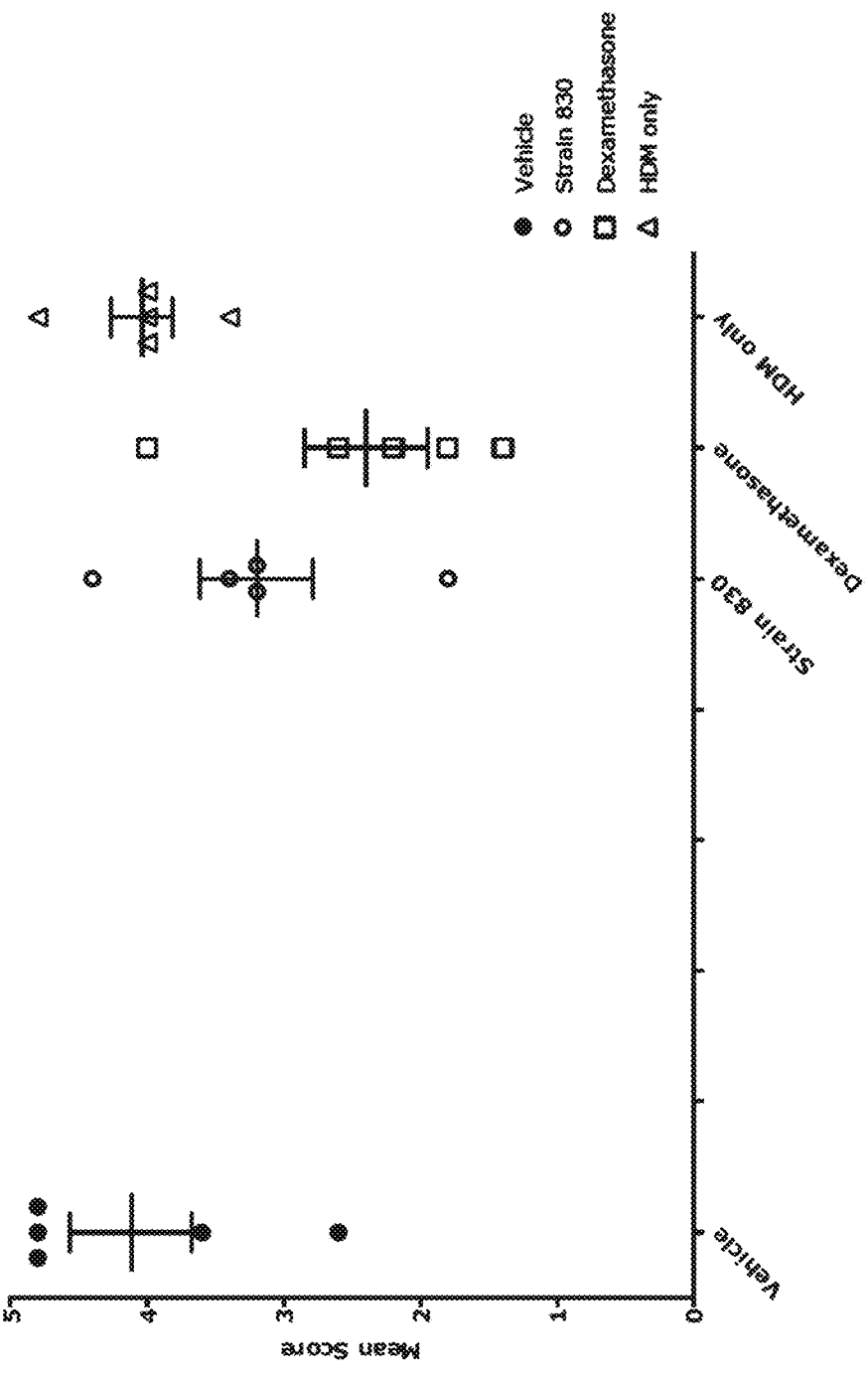
FIG. 32: Mouse model of house dust mite-induced asthma—Histological Analysis—Mean Perivascular Infiltration Score
Figure 33:
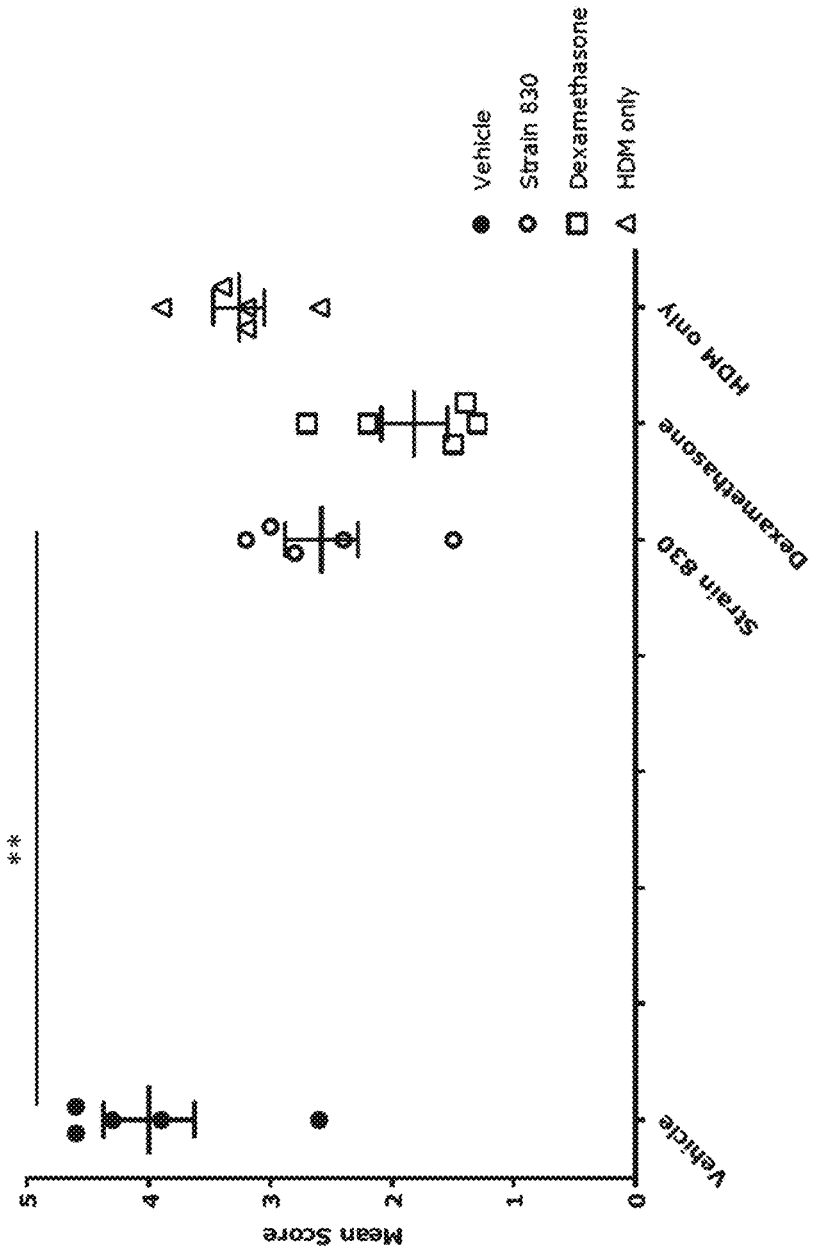
FIG. 33: Mouse model of house dust mite-induced asthma—Histological Analysis—Mean Inflammatory Score (Average of both Peribronchiolar and Perivascular Infiltration Score)
Figure 34:
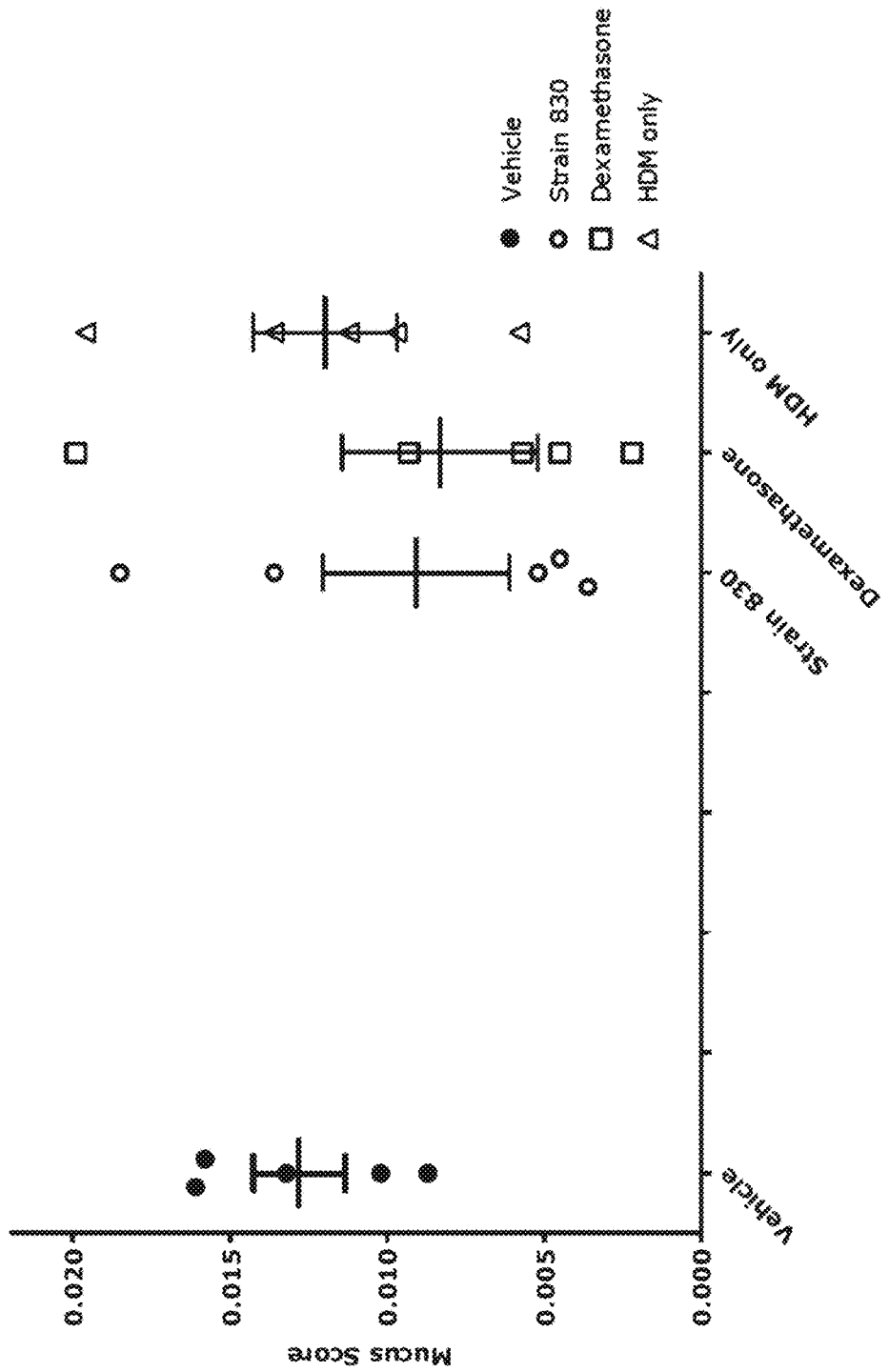
FIG. 34: Mouse model of house dust mite-induced asthma—Histological Analysis—Mucus Score
Figure 35:
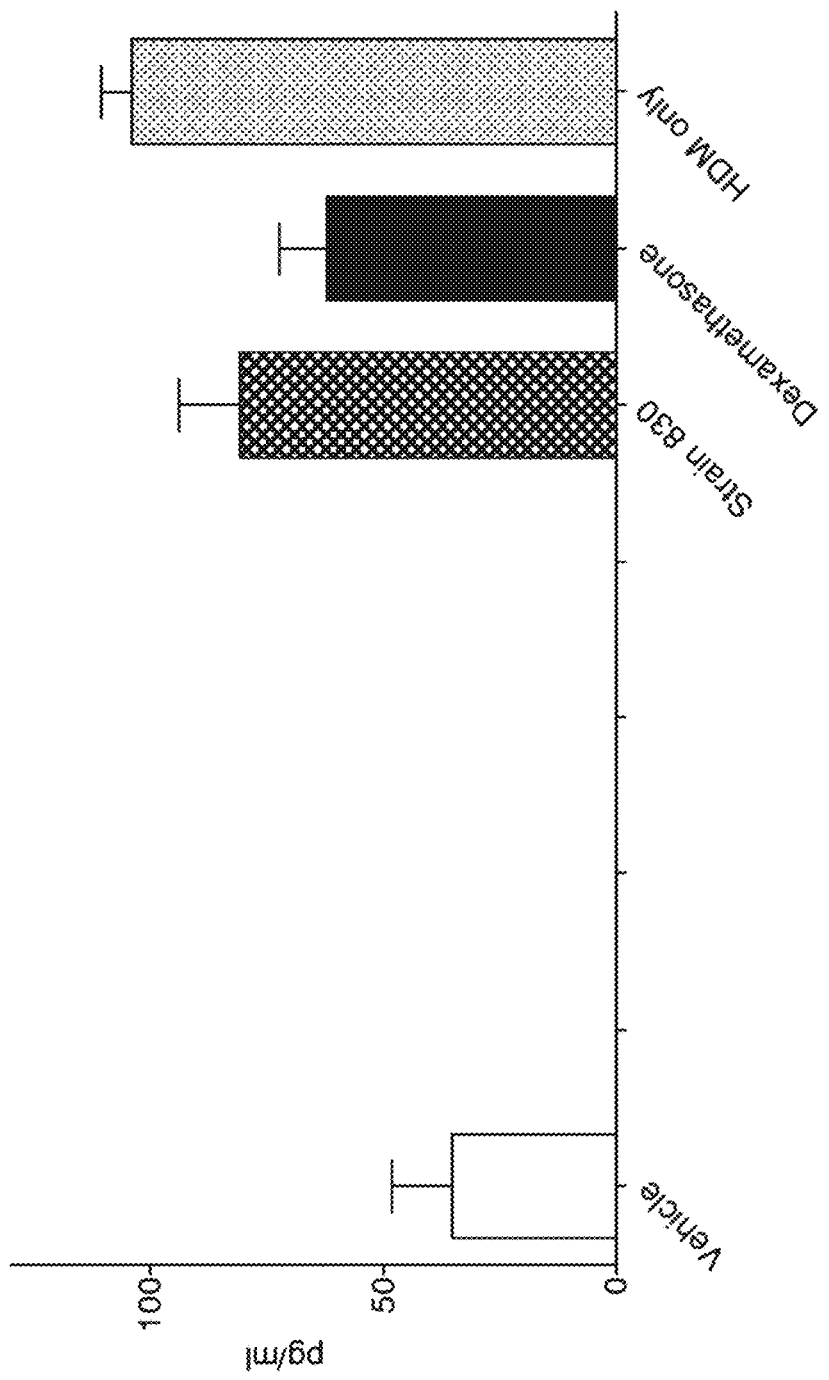
FIG. 35: Mouse model of house dust mite-induced asthma—IL-9 level in lung tissue
Figure 36:
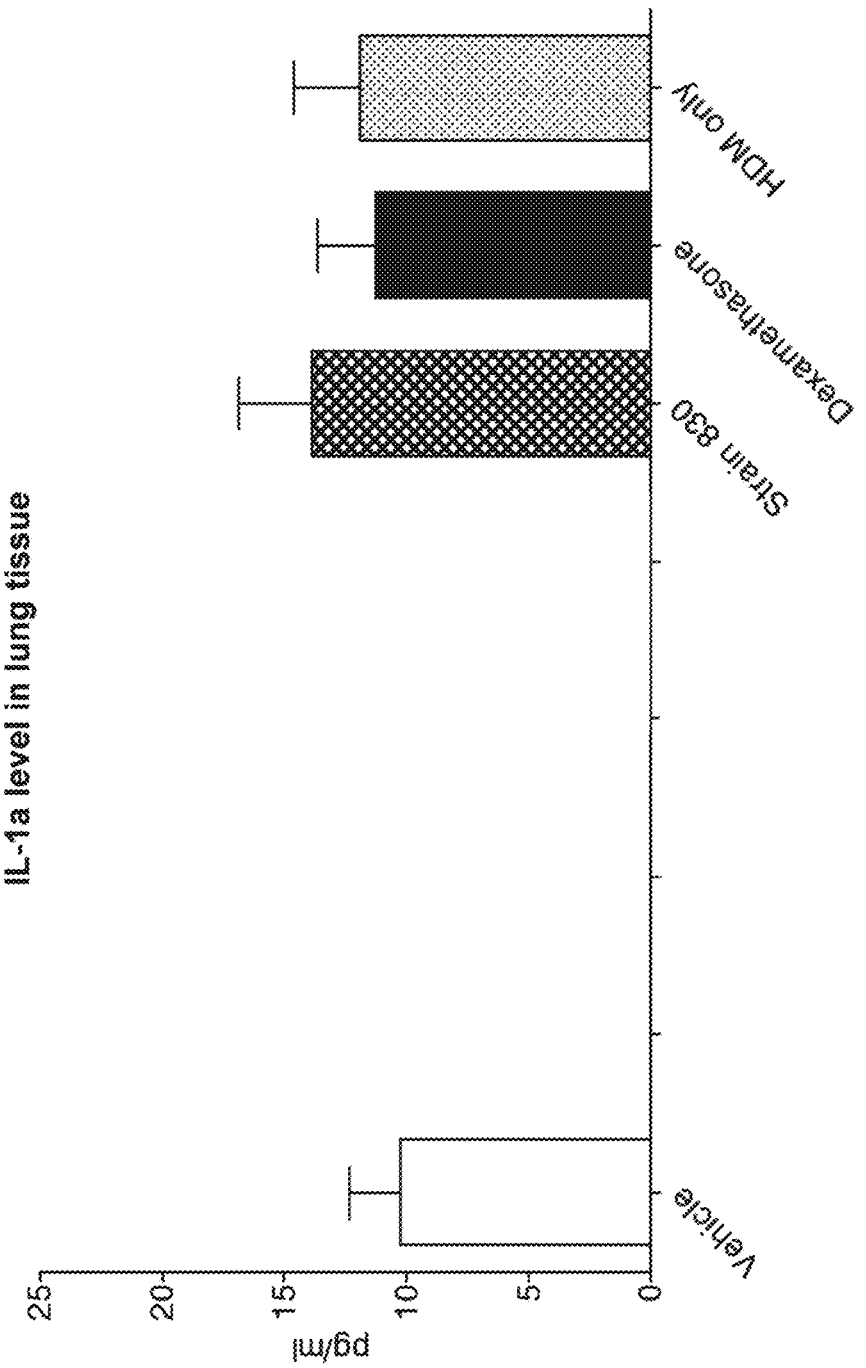
FIG. 36: Mouse model of house dust mite-induced asthma—IL-1a level in lung tissue
Figure 37:
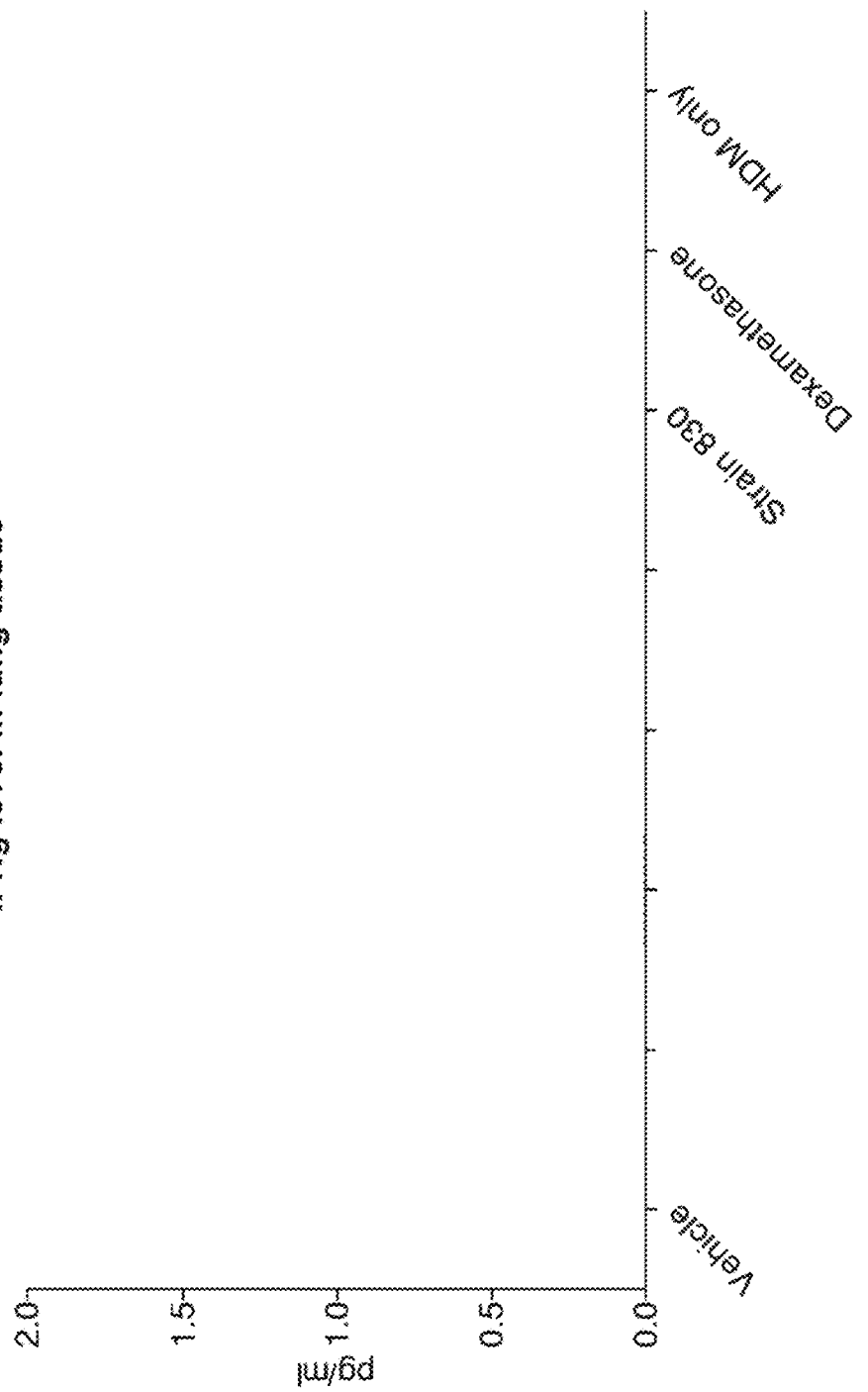
FIG. 37: Mouse model of house dust mite-induced asthma—IFNγ level in lung tissue
Figure 38:
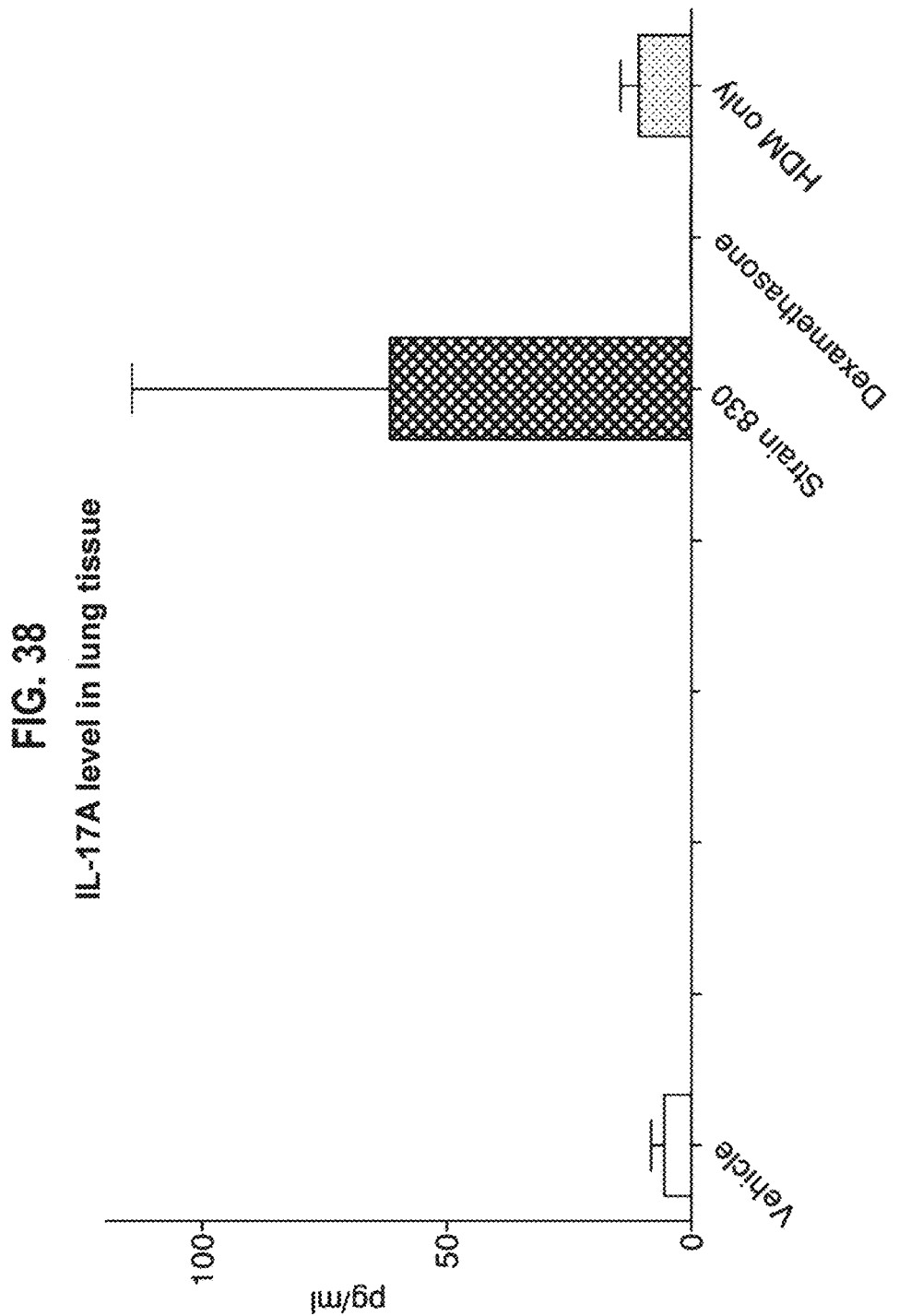
FIG. 38: Mouse model of house dust mite-induced asthma—IL-17A level in lung tissue
Figure 39:
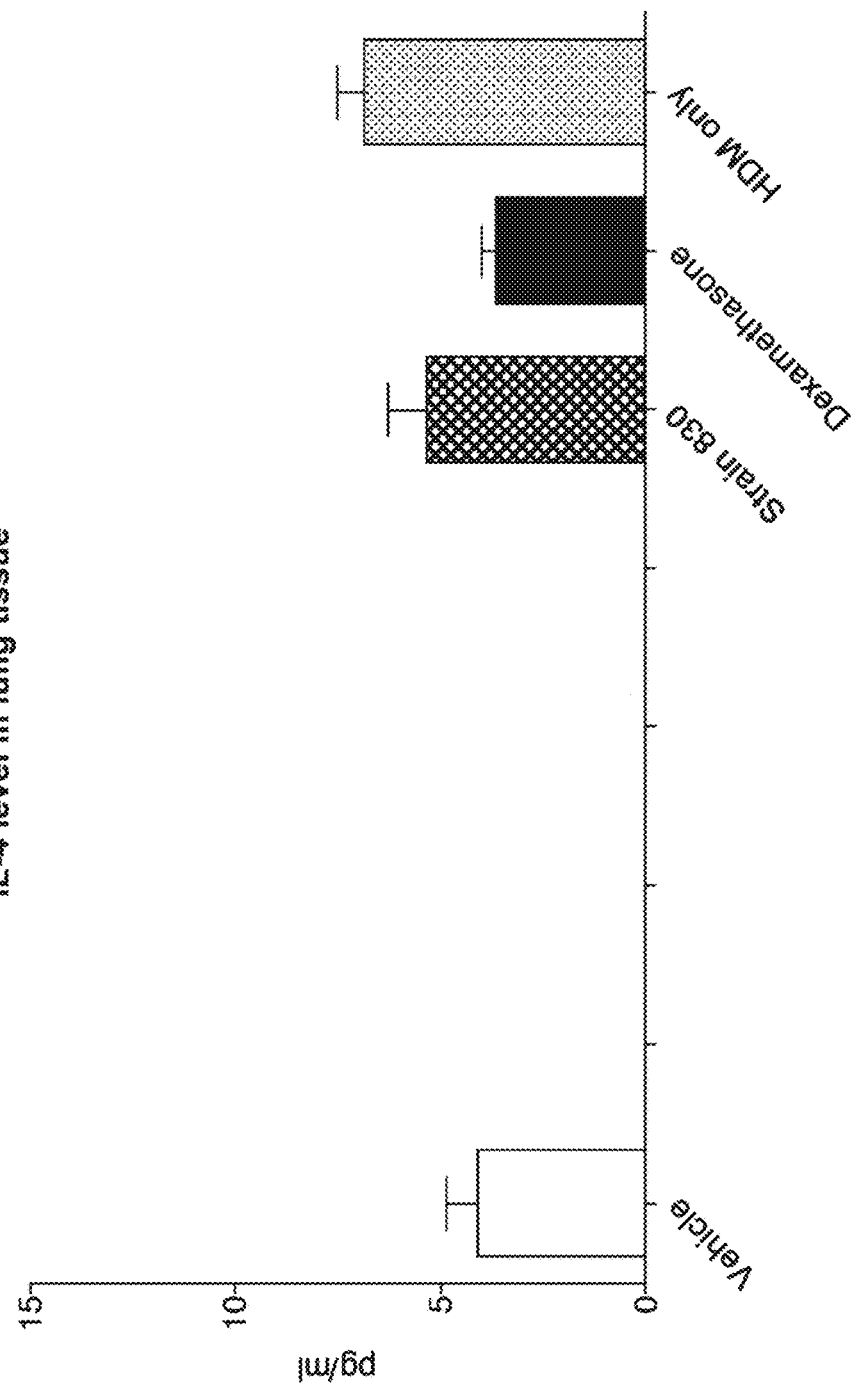
FIG. 39: Mouse model of house dust mite-induced asthma—IL-4 level in lung tissue
Figure 40:
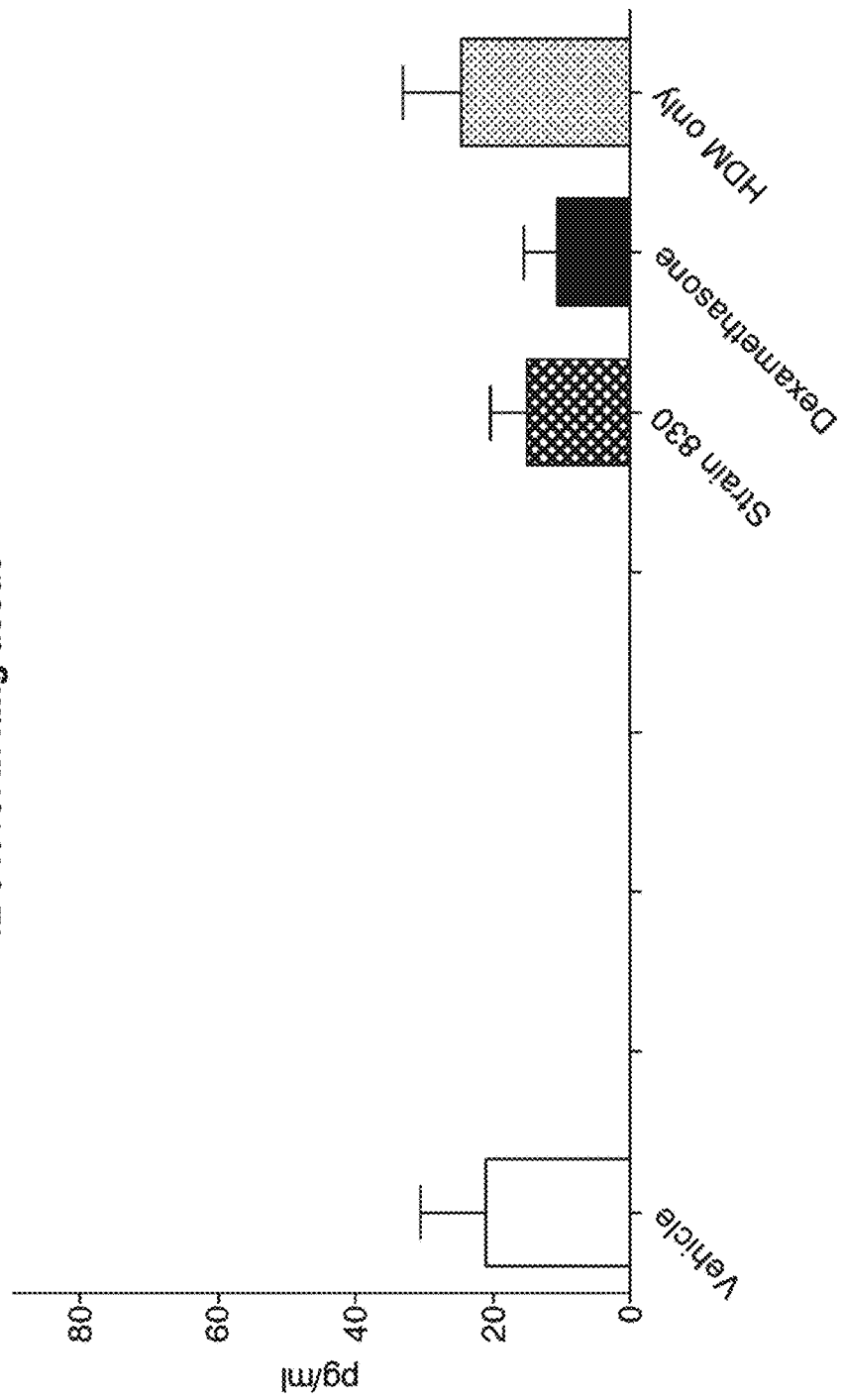
FIG. 40: Mouse model of house dust mite-induced asthma—IL-5 level in lung tissue
Figure 41:
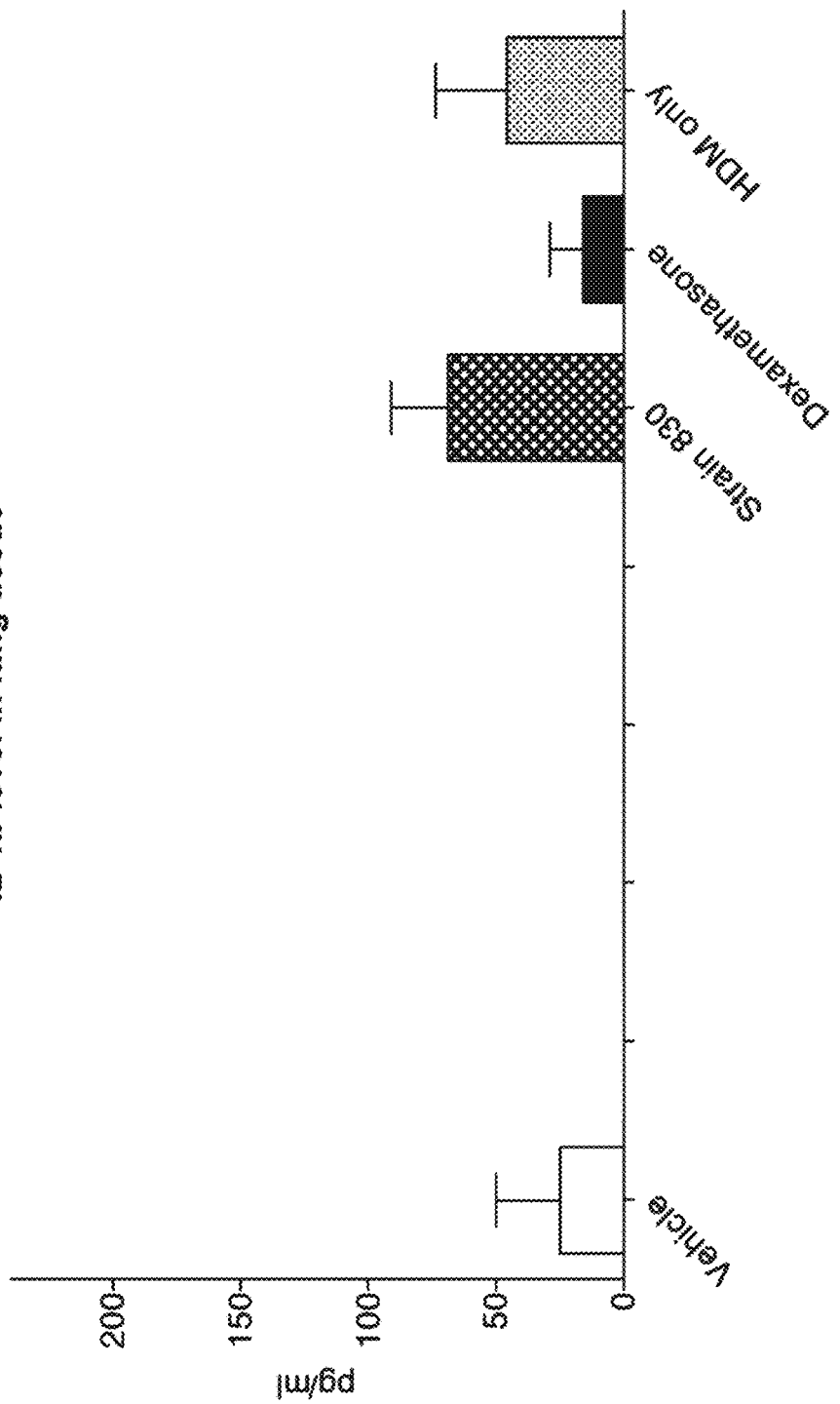
FIG. 41: Mouse model of house dust mite-induced asthma—IL-1b level in lung tissue
Figure 42:
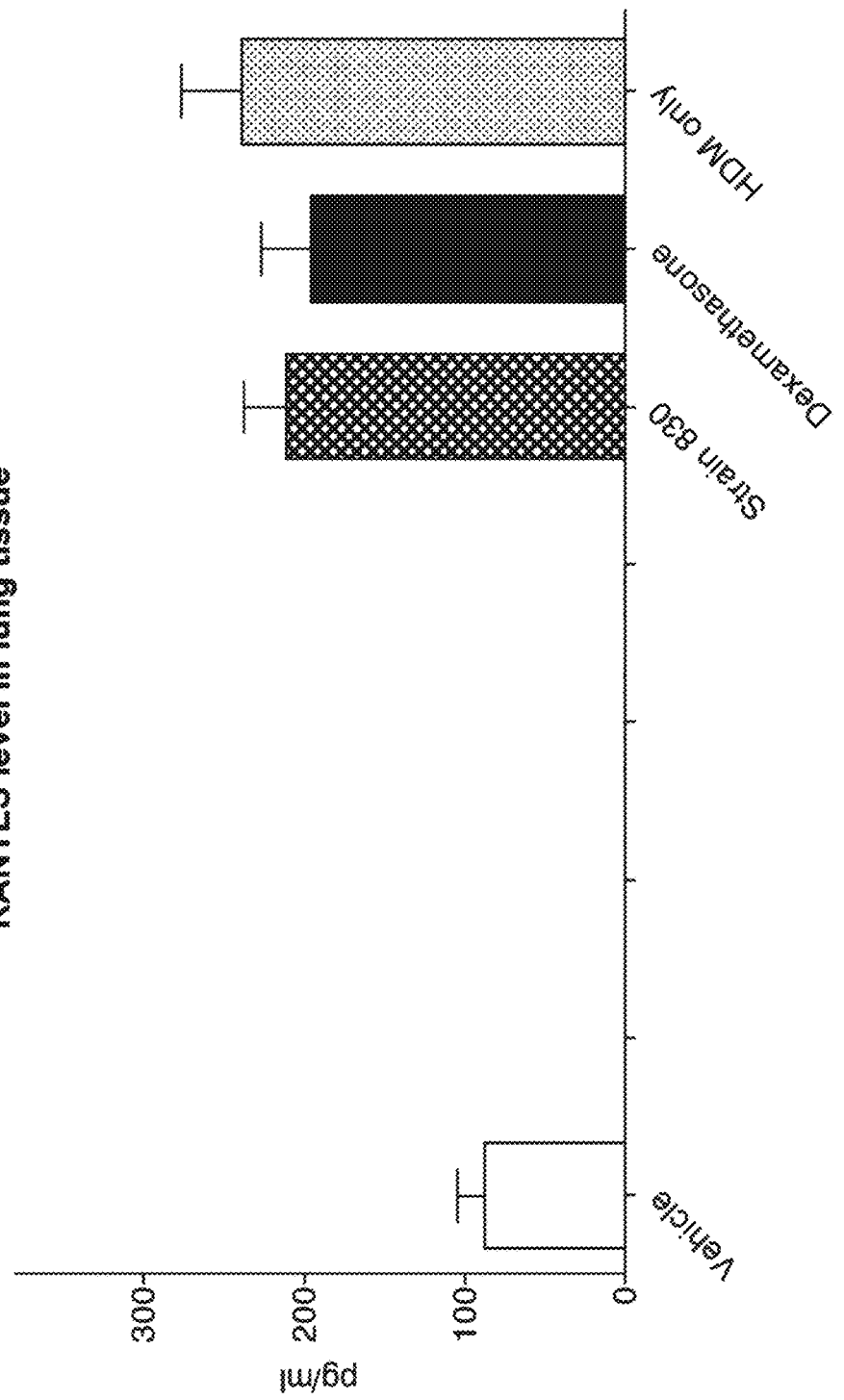
FIG. 42: Mouse model of house dust mite-induced asthma—RANTES level in lung tissue
Figure 43:
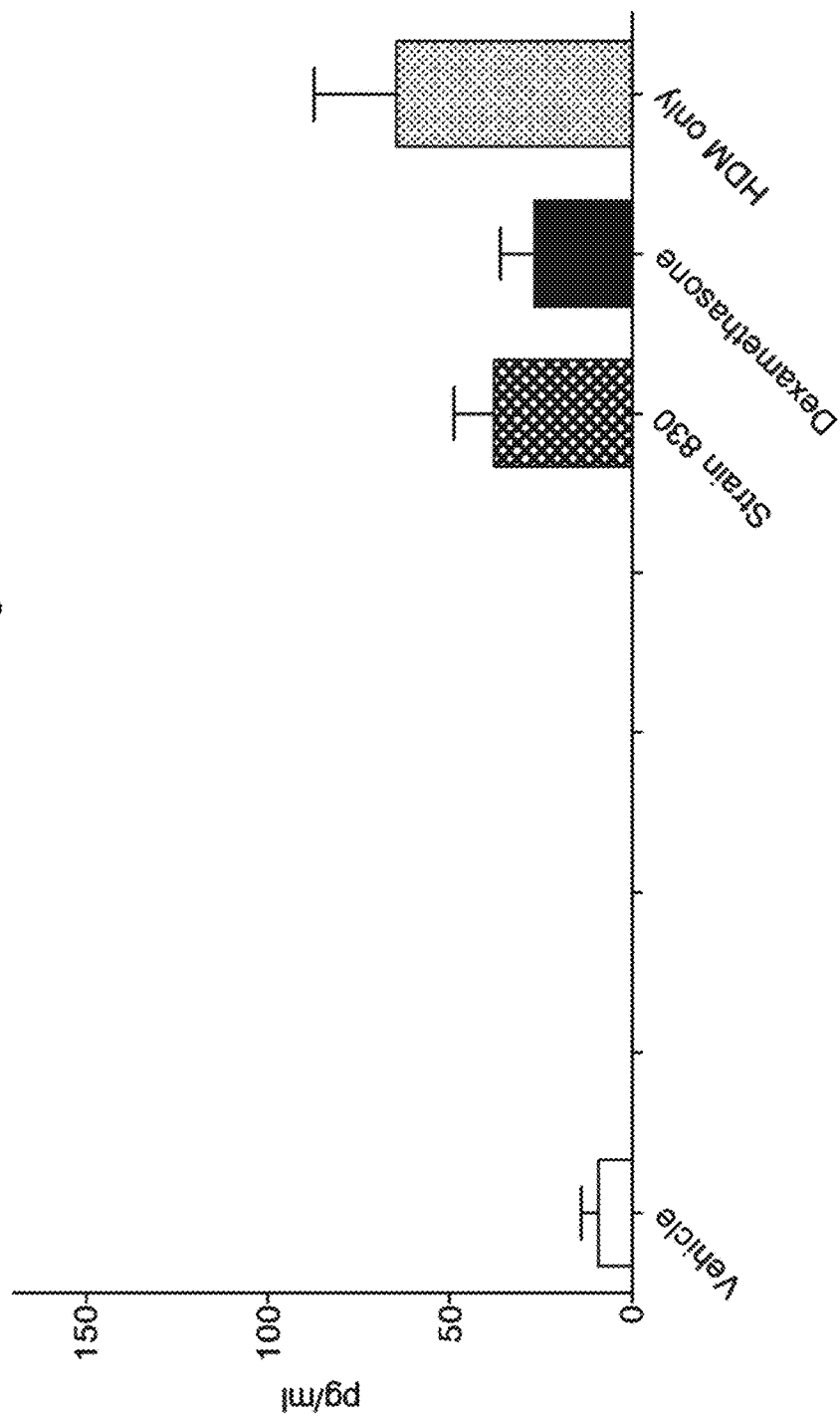
FIG. 43: Mouse model of house dust mite-induced asthma—MIP-1a level in lung tissue
Figure 44:
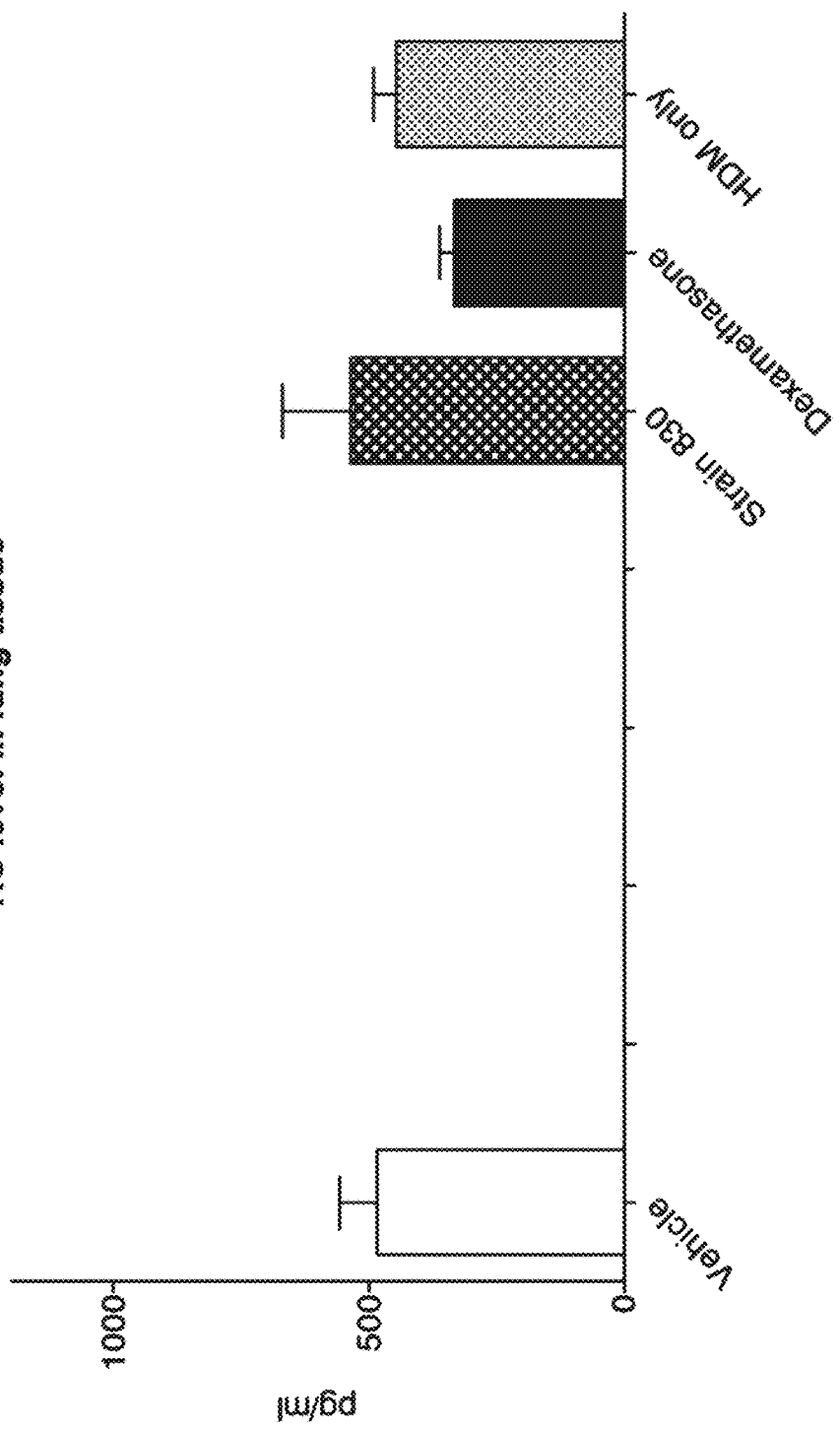
FIG. 44: Mouse model of house dust mite-induced asthma—KC level in lung tissue
Figure 45:
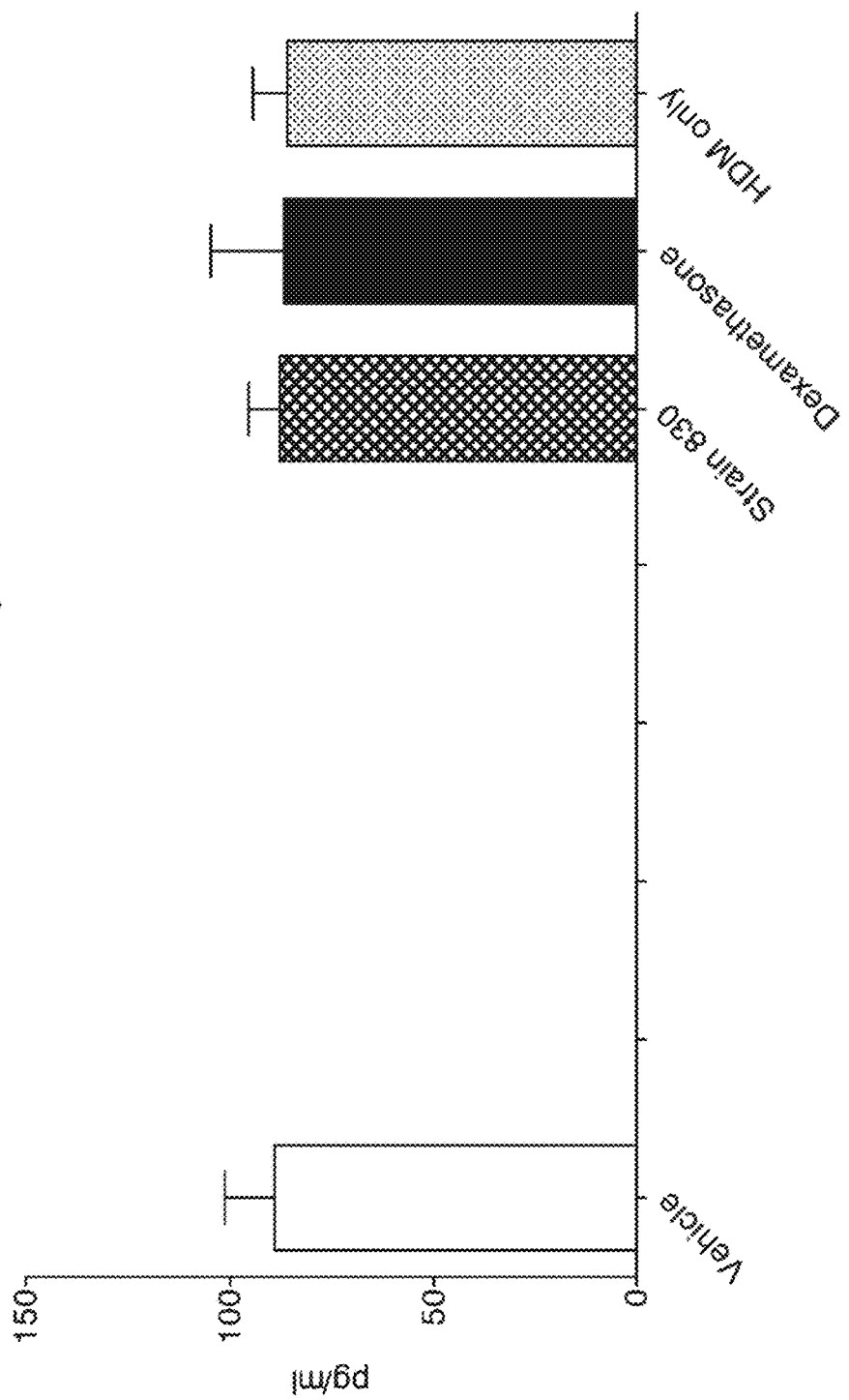
FIG. 45: Mouse model of house dust mite-induced asthma—MIP-2 level in lung tissue
Figure 46:
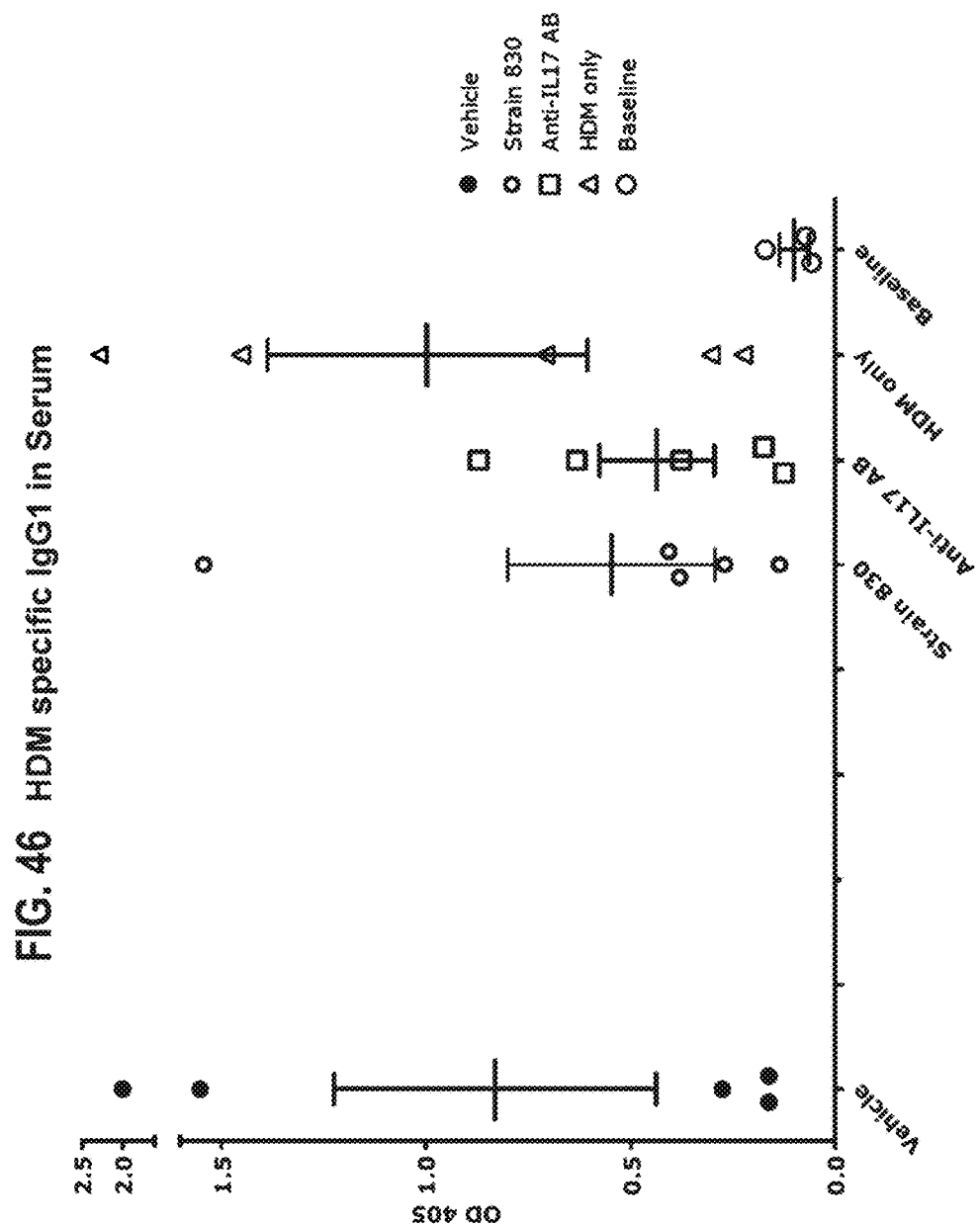
FIG. 46: Mouse model of severe neutrophilic asthma—HDM specific IgG1 in Serum
Figure 47:
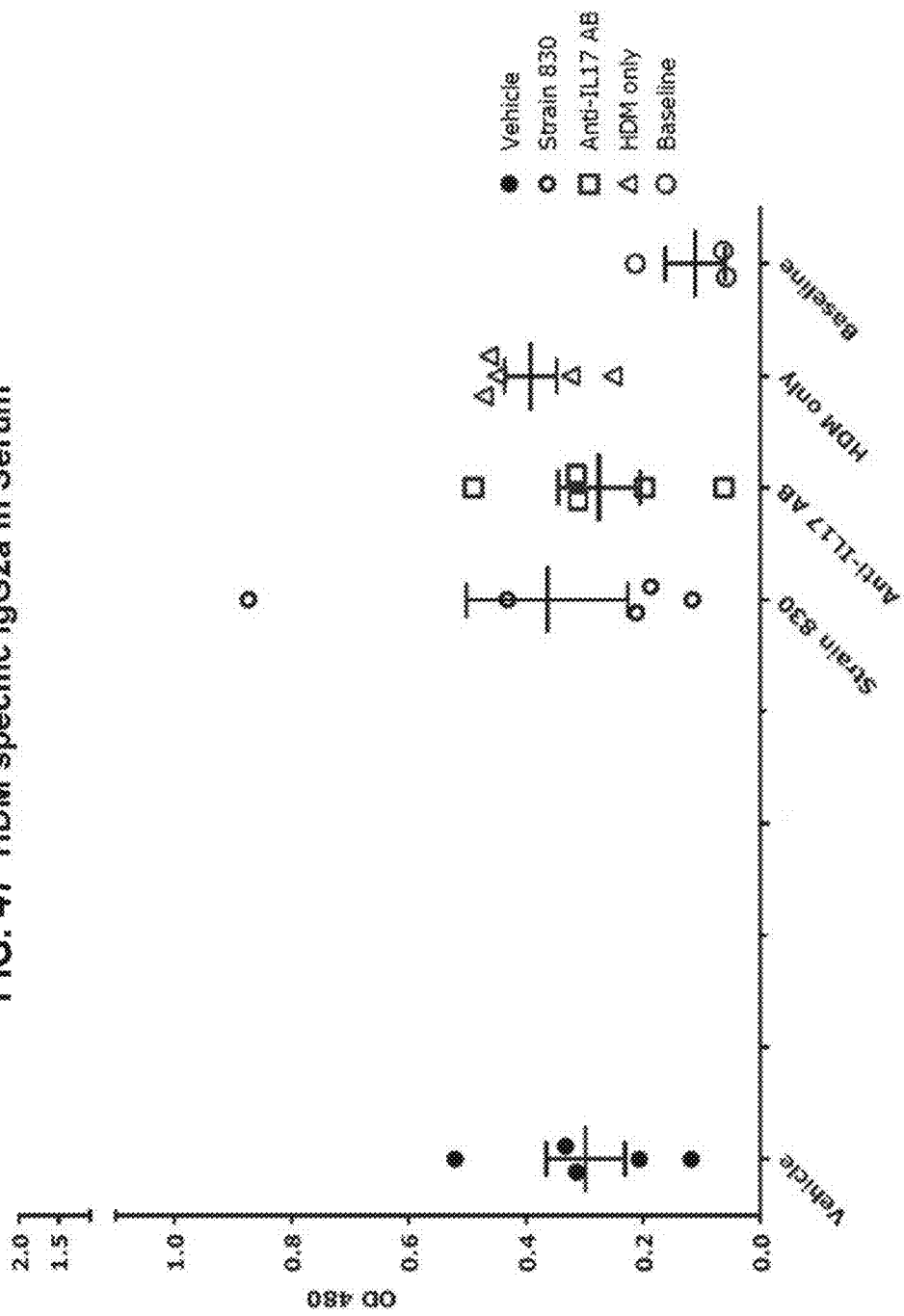
FIG. 47: Mouse model of severe neutrophilic asthma—HDM specific IgG2a in Serum
Figure 48:
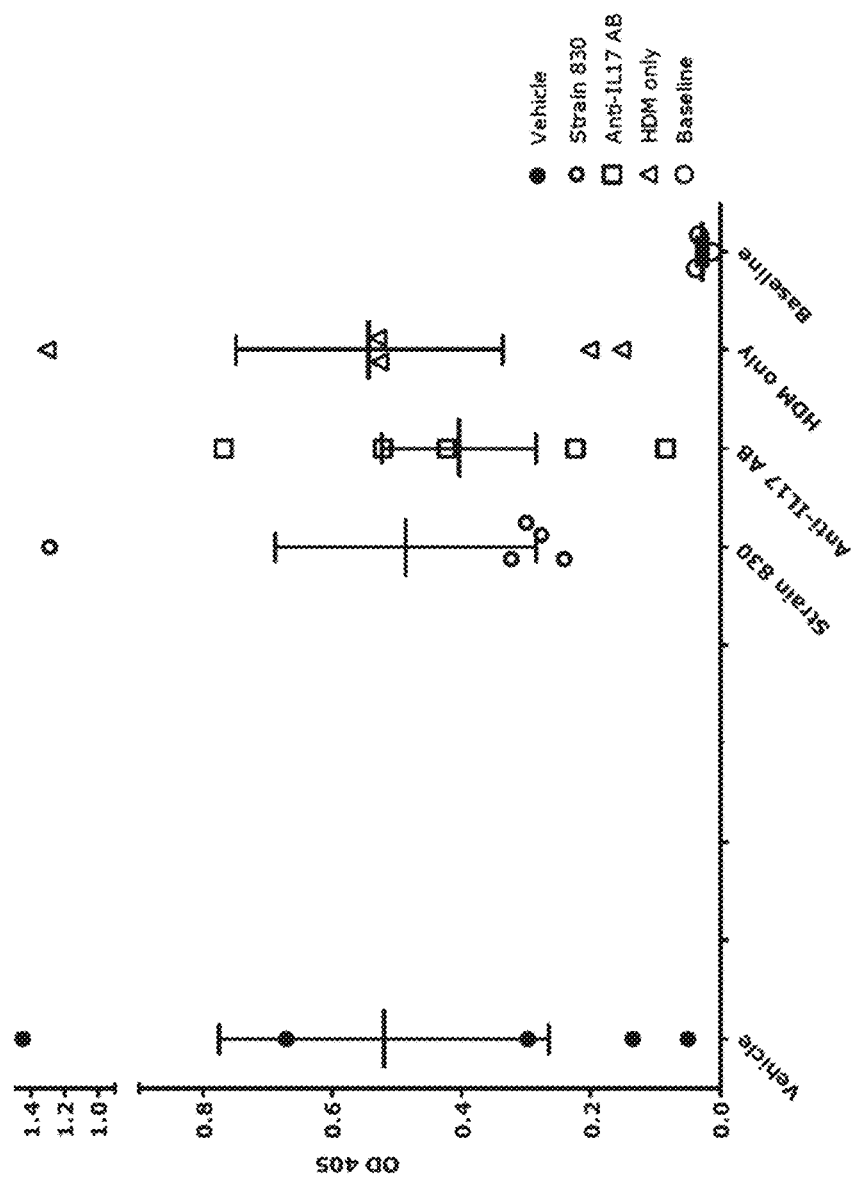
FIG. 48: Mouse model of severe neutrophilic asthma—HDM specific IgG1 in BALF
Figure 49:
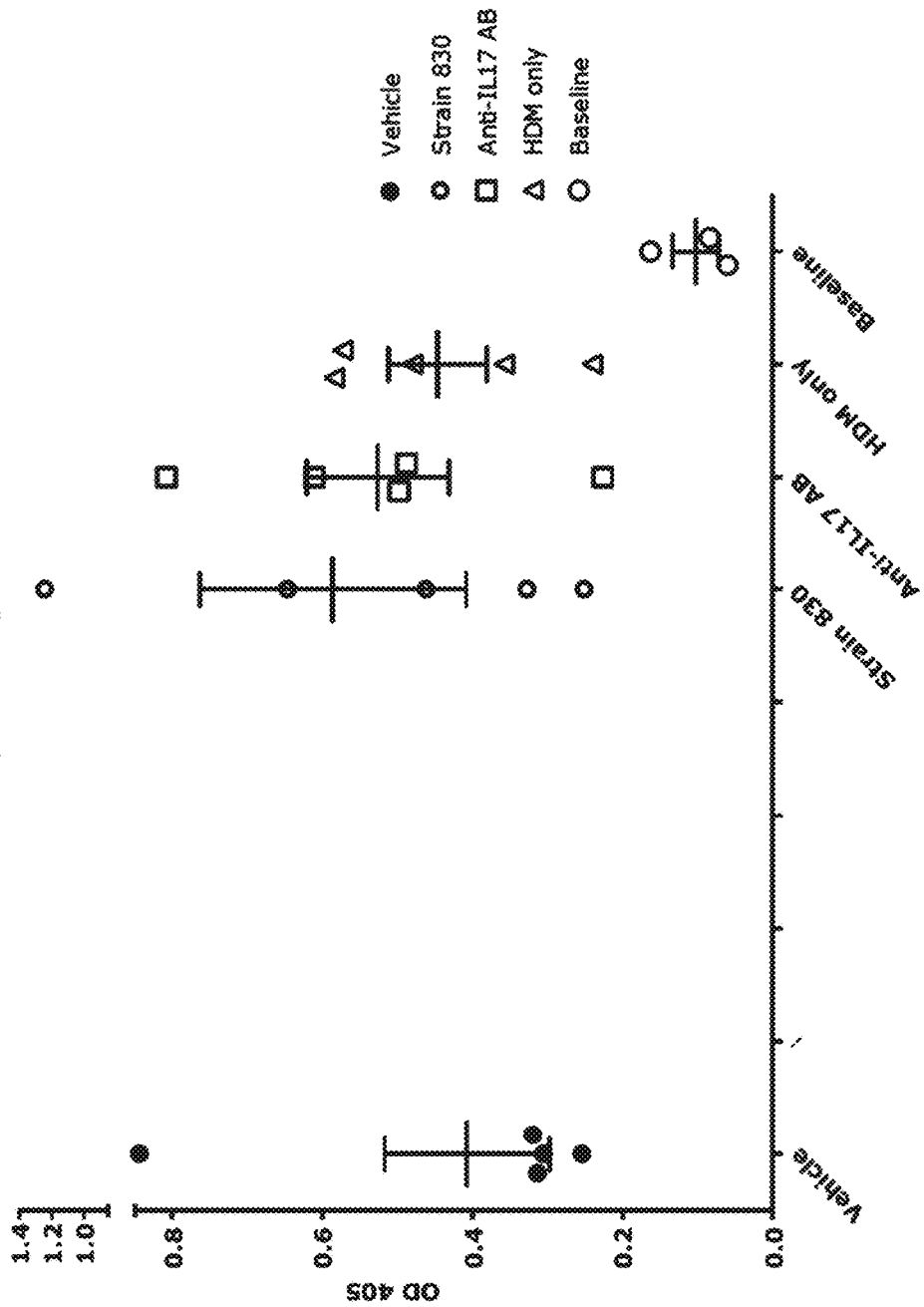
FIG. 49: Mouse model of severe neutrophilic asthma—HDM specific IgG2a in BALF
Figure 50:
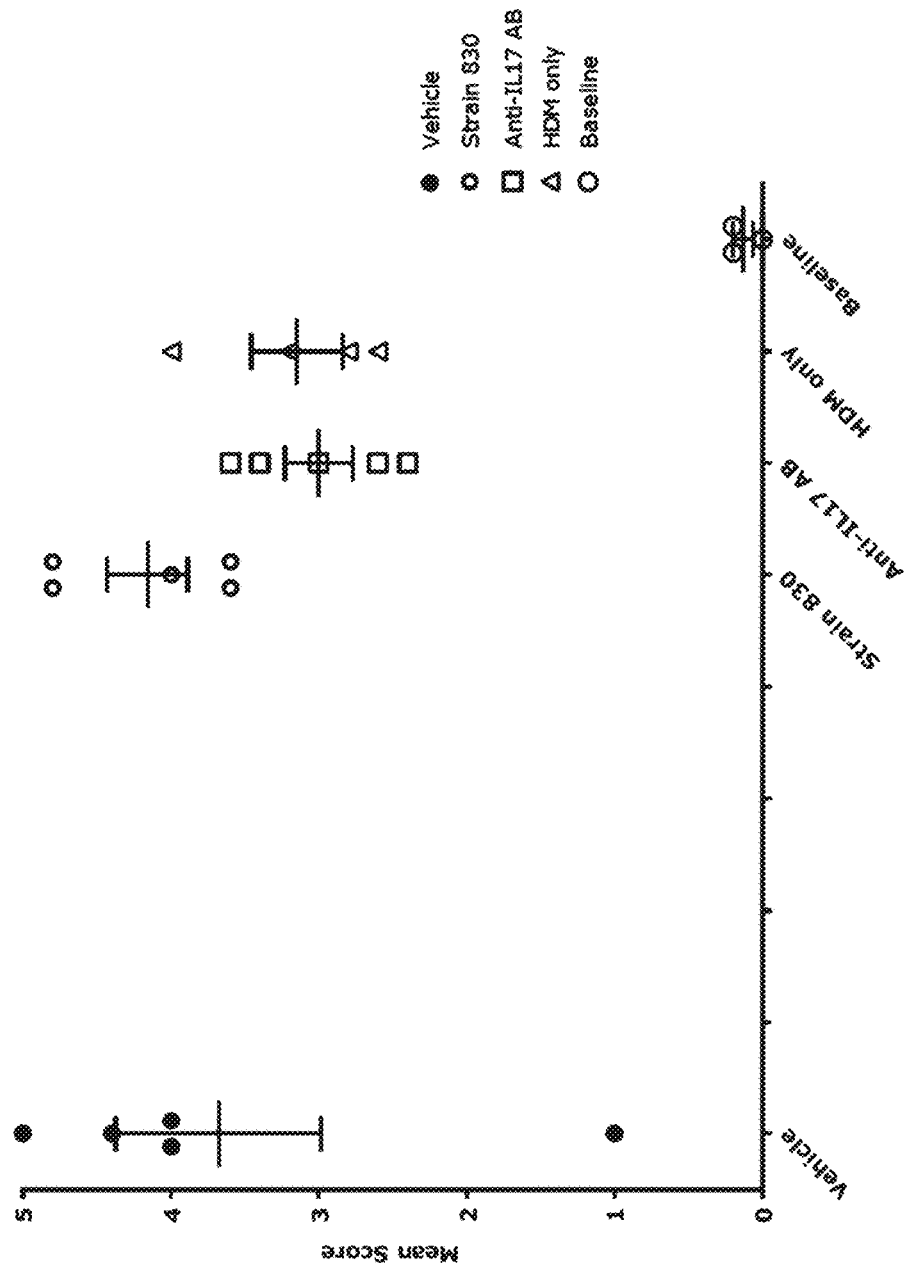
FIG. 50: Mouse model of severe neutrophilic asthma—Histological Analysis—Mean Peribronchiolar Infiltration Score
Figure 51:
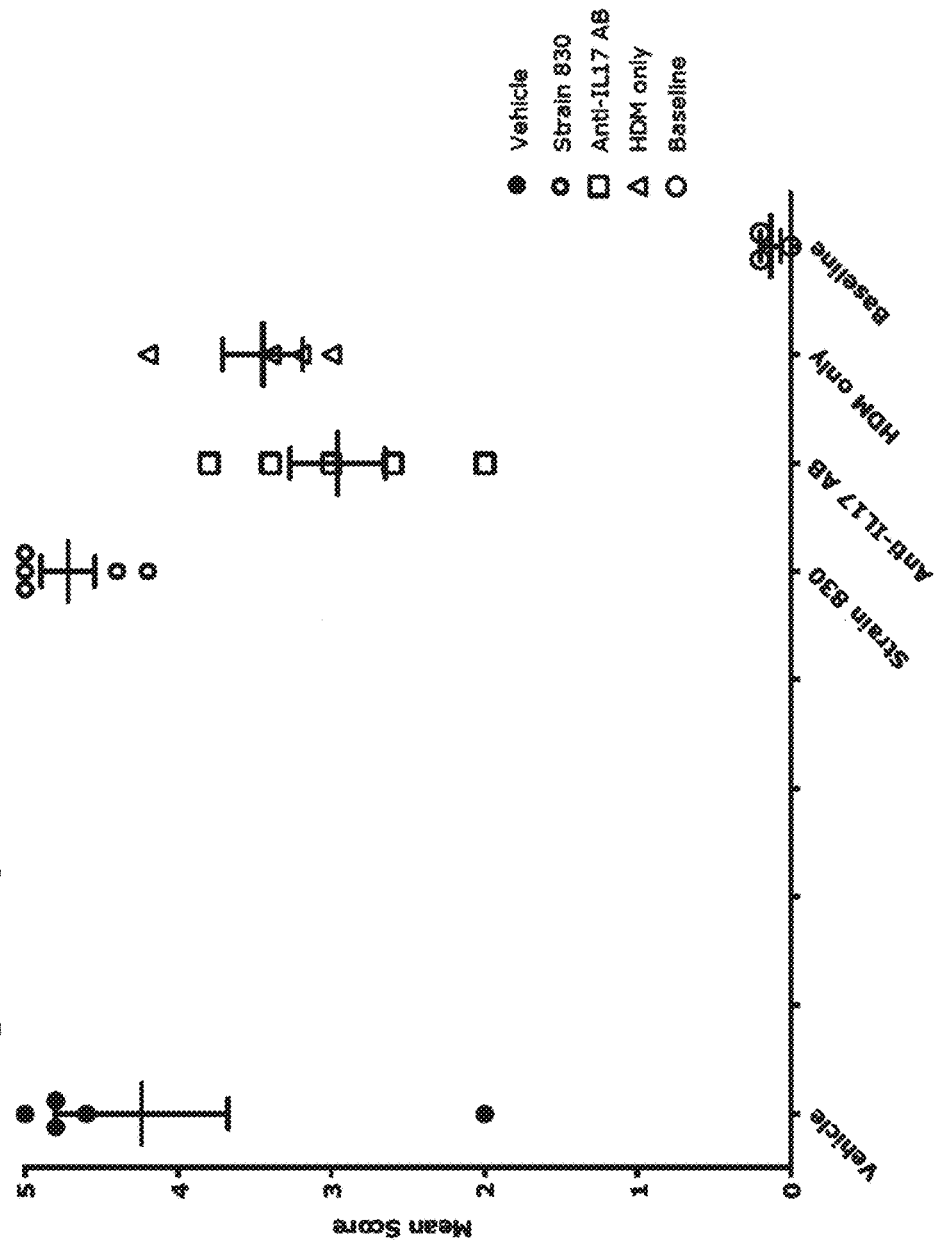
FIG. 51: Mouse model of severe neutrophilic asthma—Histological Analysis—Mean Perivascular Infiltration Score
Figure 52:
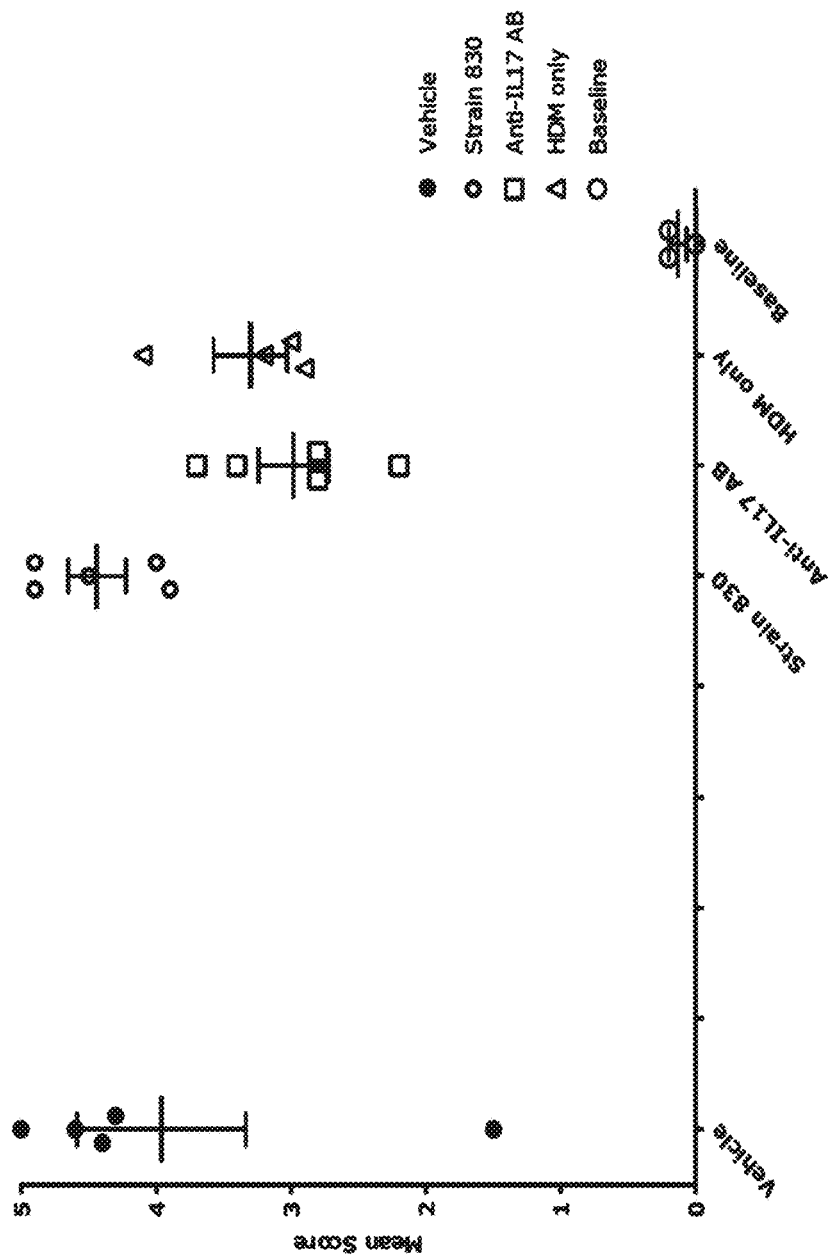
FIG. 52: Mouse model of severe neutrophilic asthma—Histological Analysis—Mean Inflammatory Score (Average of both Peribronchiolar and Perivascular Infiltration Score)

In support of the findings described in Example 1, analysis of the cellular infiltrates in the lung tissue of mice treated with strain 830 showed a notable and statistically significant reduction in mean inflammation score (see FIGS. 31 and 33).

Antibody levels in the BAL fluid and serum were analysed (see FIGS. 27-30). No clear effect of the bacterial treatment on serum antibody levels was observed. This may reflect a failure in the experiment, because the spread of data and the error bars for each treatment are large, and the positive and negative controls do not appear to have behaved as would be expected. Also, the baseline serum antibody levels could have masked any changes.

Similarly, no clear effect of the bacterial treatment on cytokine levels in lung tissue was observed (see FIGS. 35-45). Again, this may reflect a failure in the experiment, because the spread of data and the error bars for each treatment are large, and the positive and negative controls do not appear to have behaved as would be expected. It is also possible that the mechanism of action involved influences earlier cytokine responses that were no longer detectable on day 4 post the final HDM airway challenge. Some care should be taken when interpreting the cytokine data in the current study, due to the variability in the levels detected. This variability could in part be explained by the fact that the lung tissue was separated for the different analyses, and thus one lung lobe might not have been fully representative or comparable to the same lobe in other mice due to patchy distribution of the inflammation.

Example 5—Further Analysis of the Effect of Bacterial Inocula in the Mouse Model of Severe Neutrophilic Asthma The mice tested in Example 2 were subjected to further analyses to further characterise the effect of the compositions of the invention on the neutrophilic response associated with severe asthma.

Materials and Methods

Organ Removal on Day 18.

Collection of the left lung lobe in formalin for follow-on histological analysis. Collection of the right lung lobes (all remaining lobes) and removal of serum for snap freezing and follow-on analysis. Remaining BAL fluid was snap frozen for follow-on analysis.

Measurement of Inflammatory Mediators in Lung Tissue (Follow-on Analysis).

Right lung lobes (all remaining lobes) isolated for quantification of inflammatory mediators were snap frozen for subsequent measurement of IFN-gamma, IL-1 alpha, IL-1 beta, CXCL1, CCL3, CXCL2, CCL5, IL-17A, TNF-alpha, IL-17F, IL-23 and IL-33 by commercially available multiplex assay (Merck-Millipore). Analysis was performed according to the manufacturer's instructions.

Measurement of Antibody Levels in Serum and BAL Fluid (Follow-on Analysis).

House-dust-mite (HDM) specific IgG1 and IgG2a antibody production were measured in the BAL and serum by ELISA assay.

Isolation of Lung and Histological Analysis (Follow-on Analysis).

Left lung lobes were fixed in formalin followed by embedment in paraffin, sectioning, and staining with hematoxylin and eosin and PAS. Subsequent histological scoring was performed blinded as followed: Five random fields of view per sample were scored for inflammation (peribronchial infiltration and perivascular infiltration) and mucus production. Inflammatory infiltration was scored with the following grading system:

0—normal
1—mild inflammatory infiltrates
2—moderate inflammatory infiltrates
3—marked inflammatory infiltrates
4—severe inflammatory infiltrates
5—very severe inflammatory infiltrates Results and Analysis The results of the experiments are shown in FIGS. 46-63.

In relation to cytokine levels, as for Example 4, the spread of data and the error bars for each treatment are large, and the positive and negative controls do not appear to have behaved as necessarily would be expected. It is also possible that the mechanism of action involves influencing earlier cytokine responses that were no longer detectable on day 4 post the final HDM airway challenge. Some care should be taken when interpreting the cytokine data in the current study, due to the variability in the levels detected. This variability could in part be explained by the fact that the lung tissue was separated for the different analyses, and thus one lung lobe might not have been fully representative or comparable to the same lobe in other mice due to patchy distribution of the inflammation. Despite this variability, a clear anti-inflammatory effect on cytokine levels for strain 830 was shown, and the positive control anti-IL-17 Ab generally behaved as expected.

Figure 53:
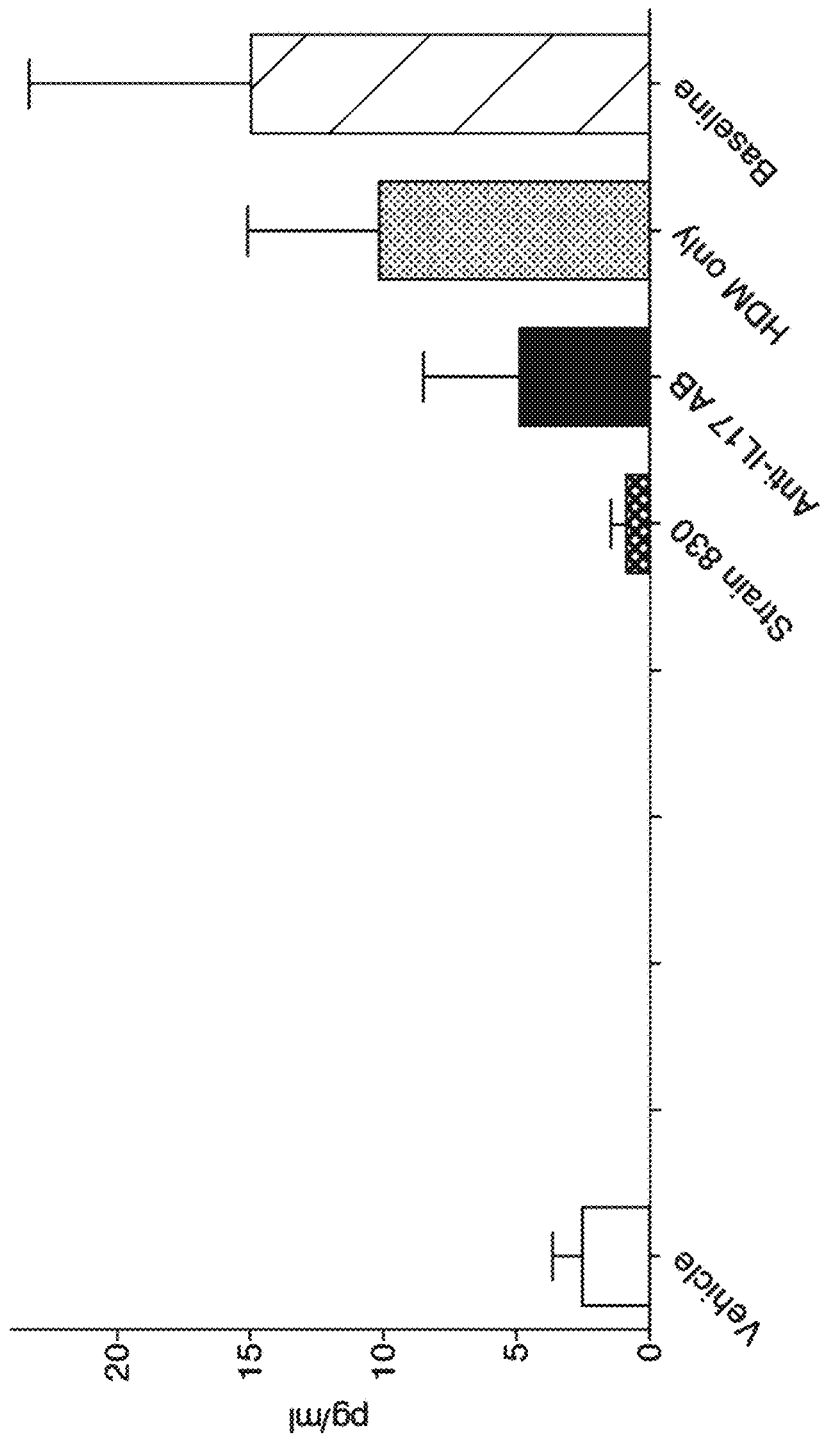
FIG. 53: Mouse model of severe neutrophilic asthma—TNFα level in lung tissue
Figure 54:
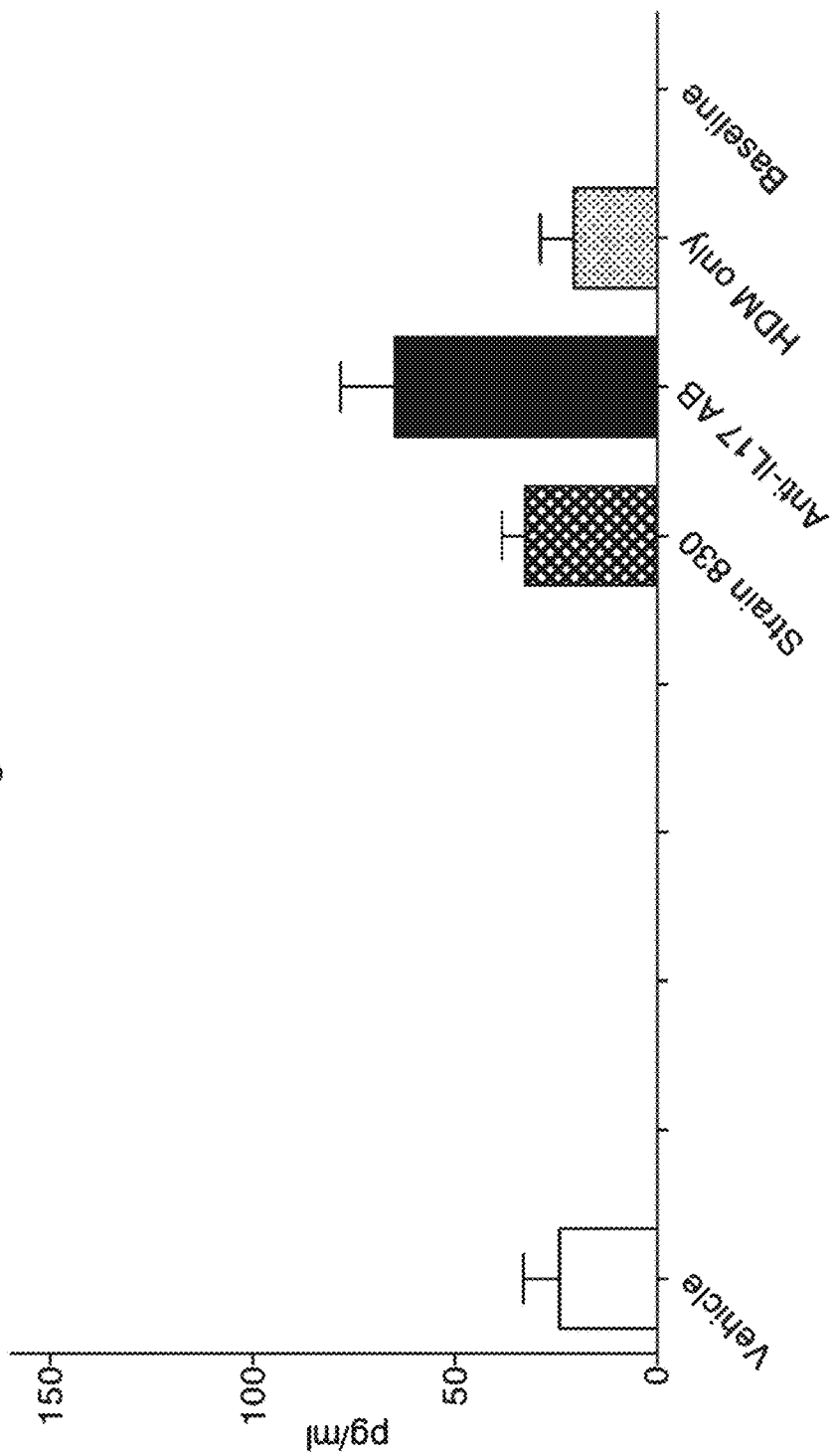
FIG. 54: Mouse model of severe neutrophilic asthma—IL-1a level in lung tissue
Figure 55:
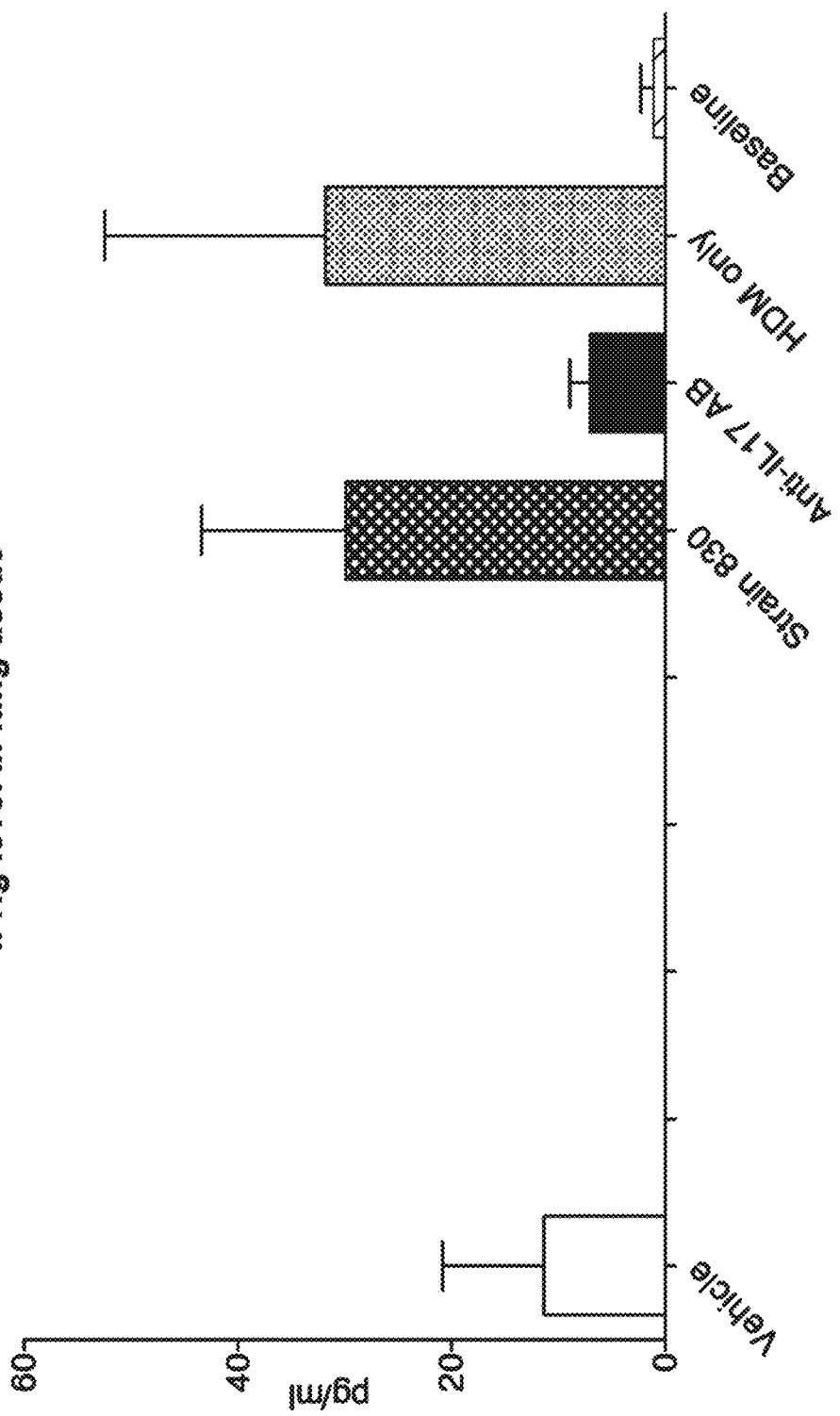
FIG. 55: Mouse model of severe neutrophilic asthma—IFNγ level in lung tissue
Figure 56:
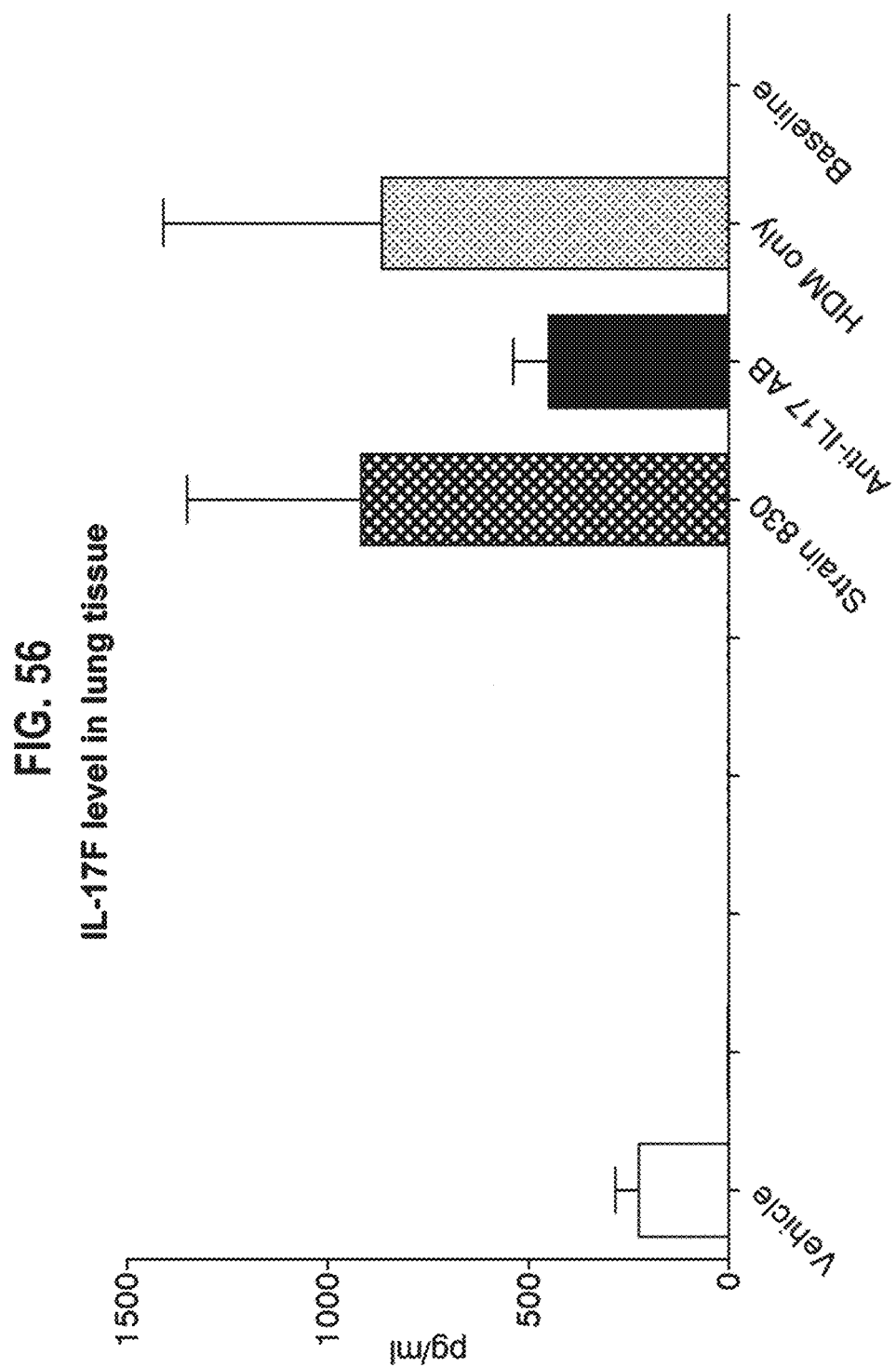
FIG. 56: Mouse model of severe neutrophilic asthma—IL-17F level in lung tissue
Figure 57:
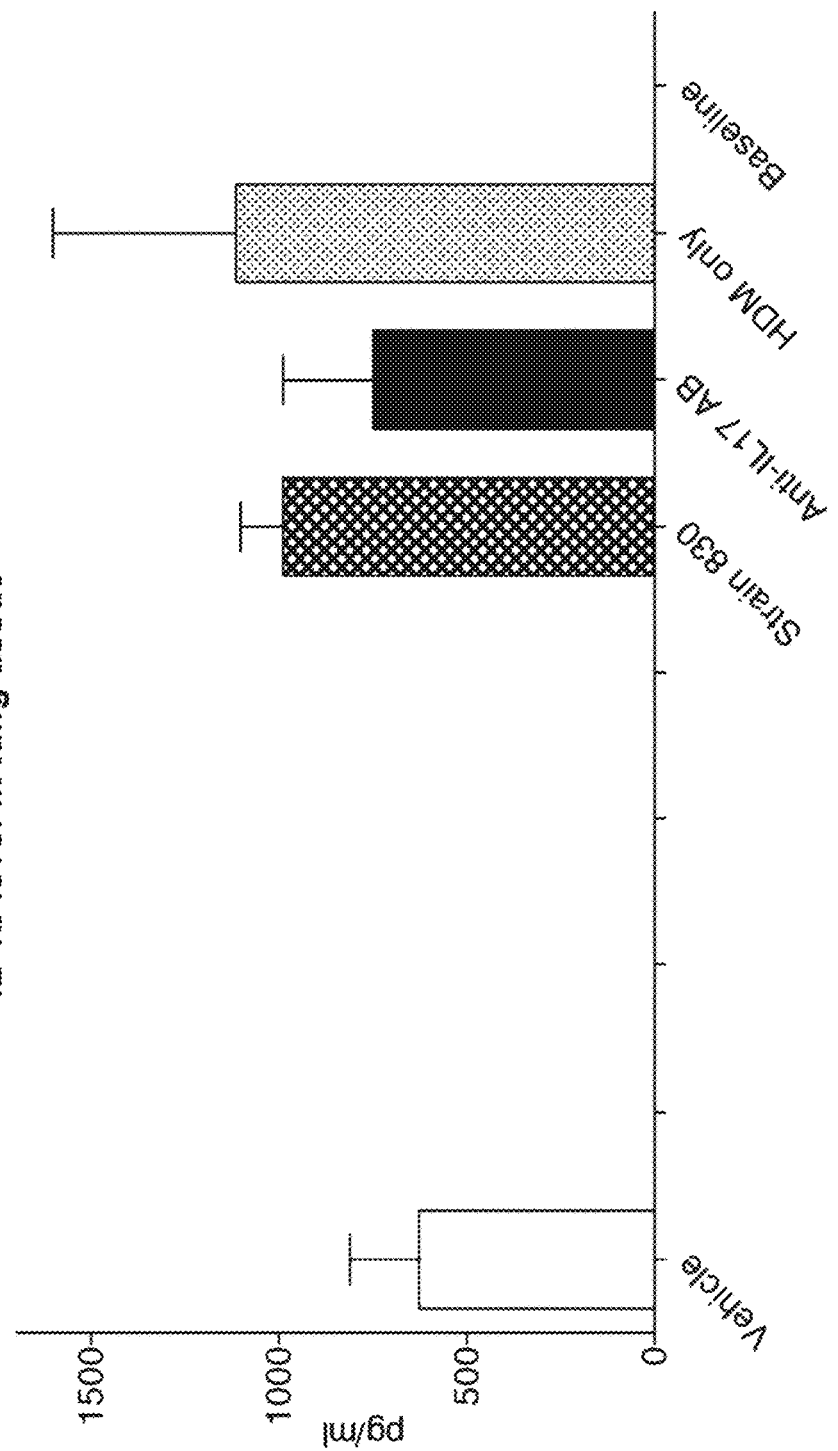
FIG. 57: Mouse model of severe neutrophilic asthma—IL-1b level in lung tissue
Figure 58:
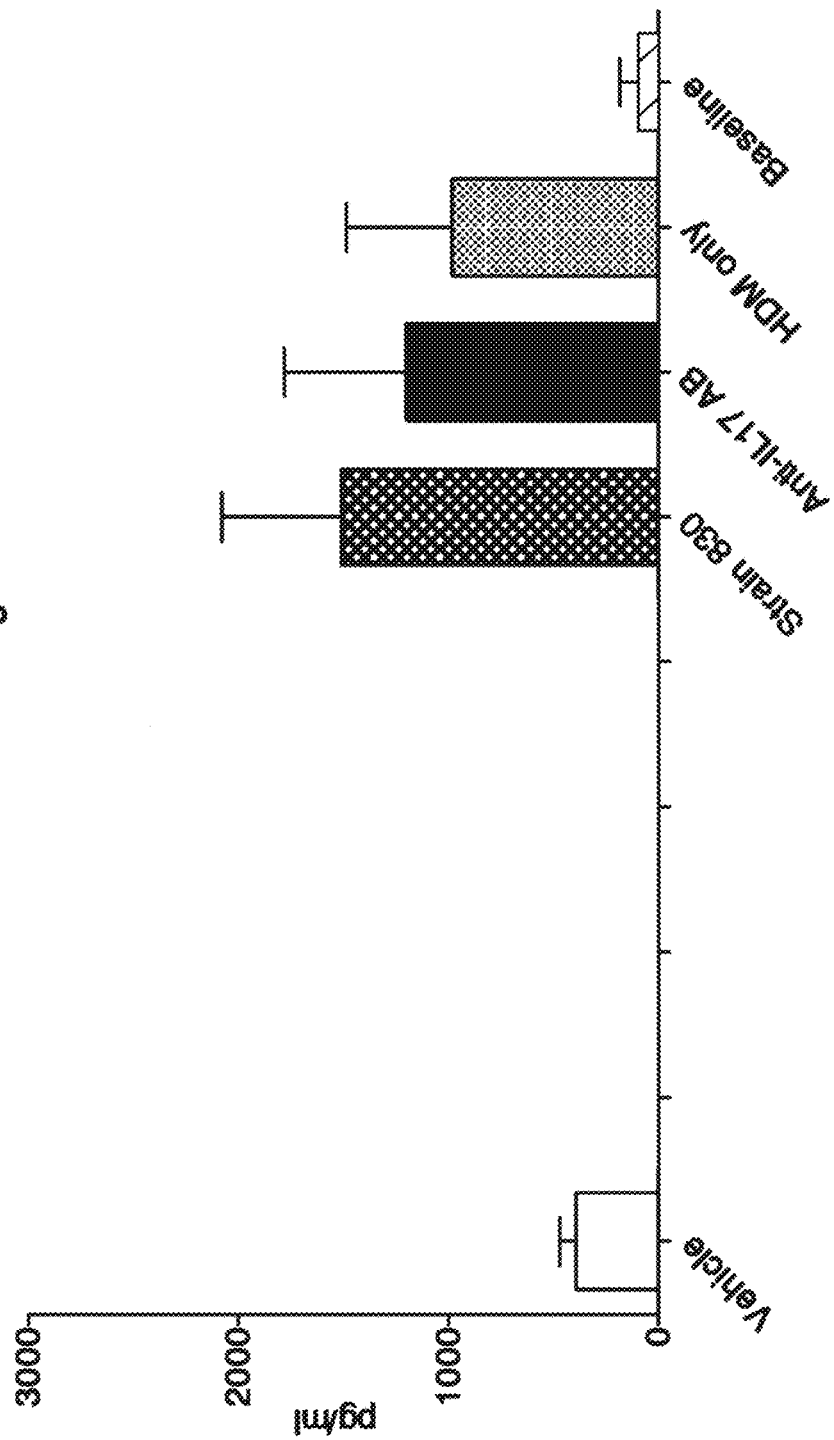
FIG. 58: Mouse model of severe neutrophilic asthma—RANTES level in lung tissue
Figure 59:
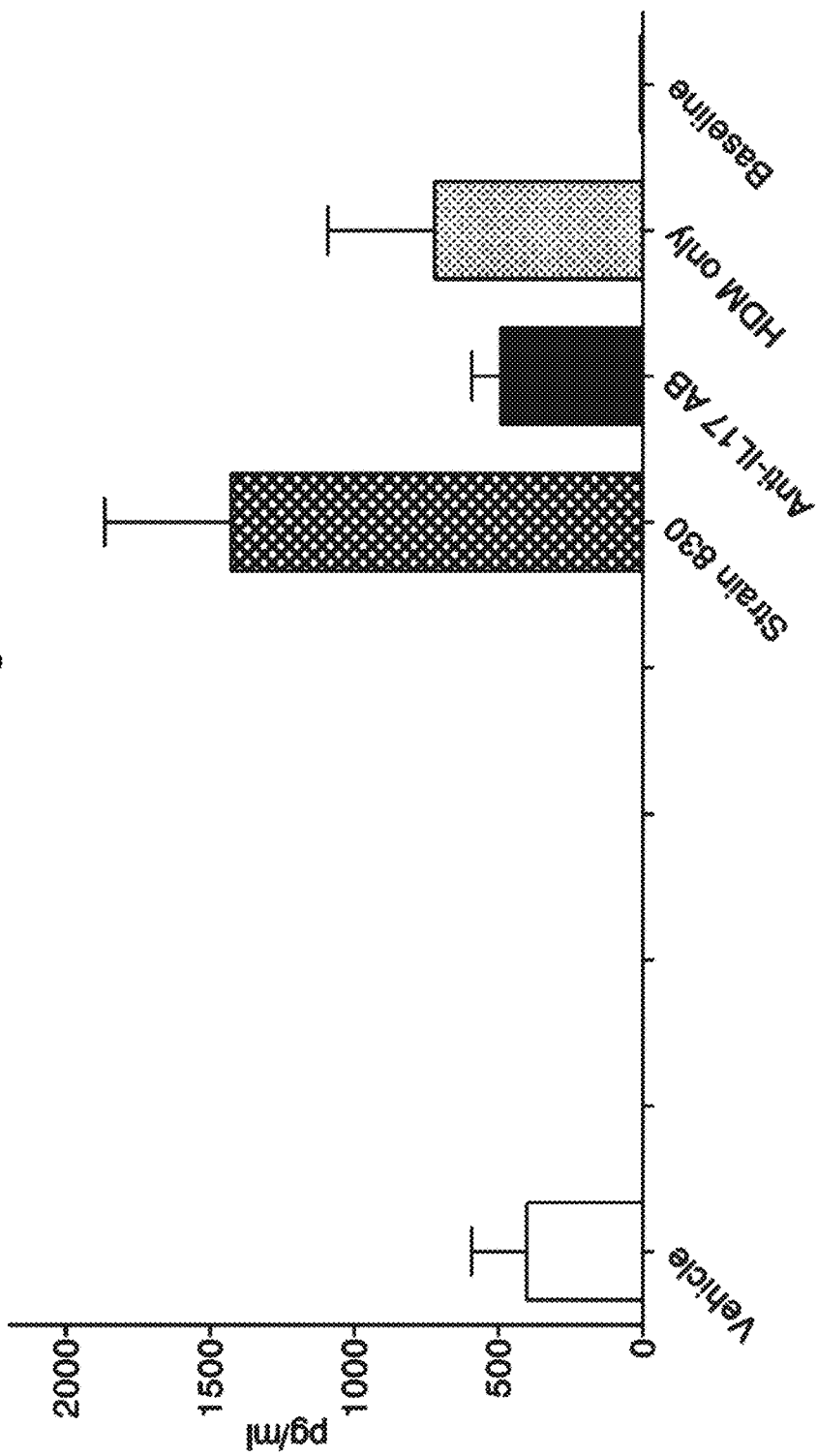
FIG. 59: Mouse model of severe neutrophilic asthma—MIP-2 level in lung tissue
Figure 60:
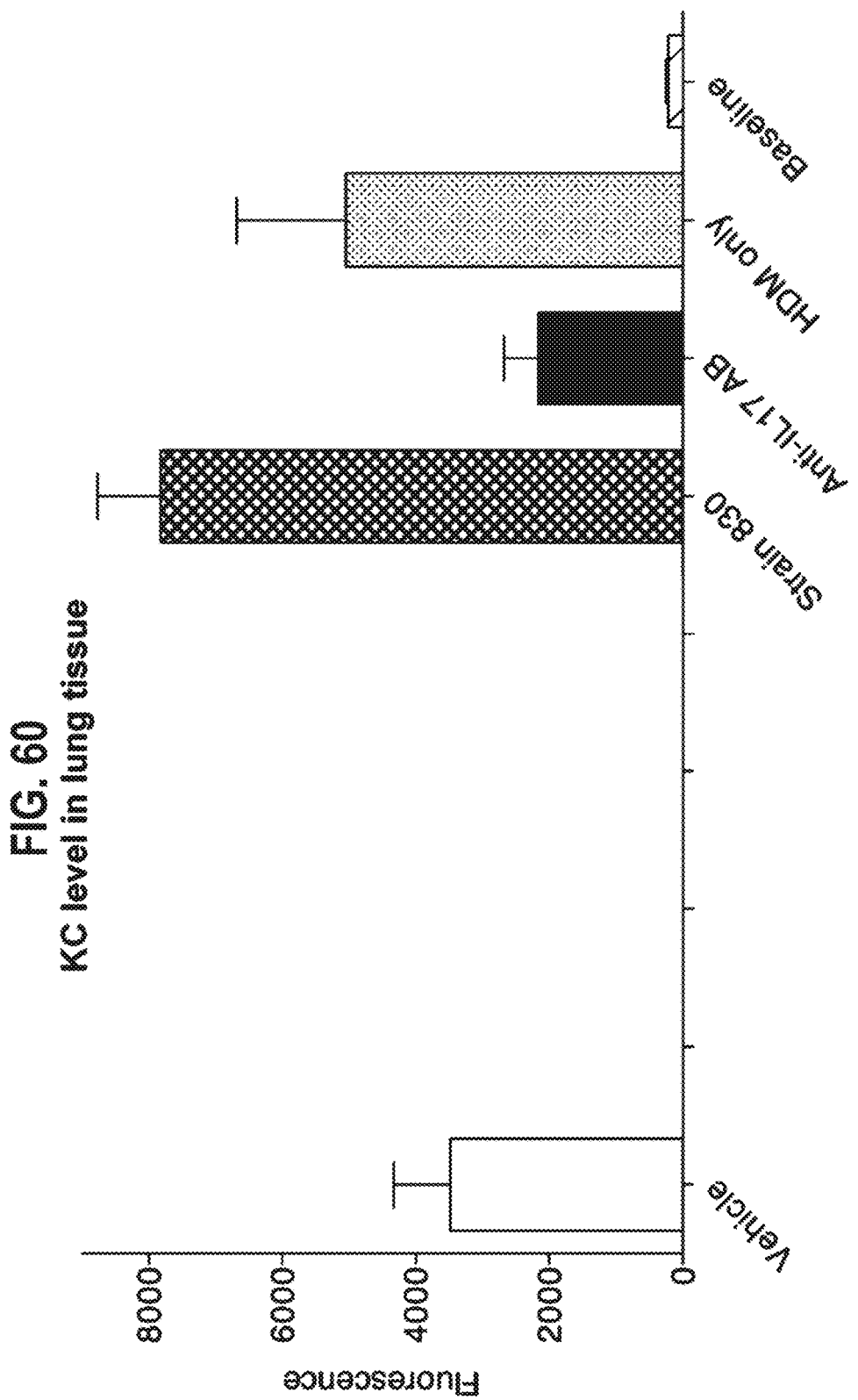
FIG. 60: Mouse model of severe neutrophilic asthma—KC level in lung tissue
Figure 61:
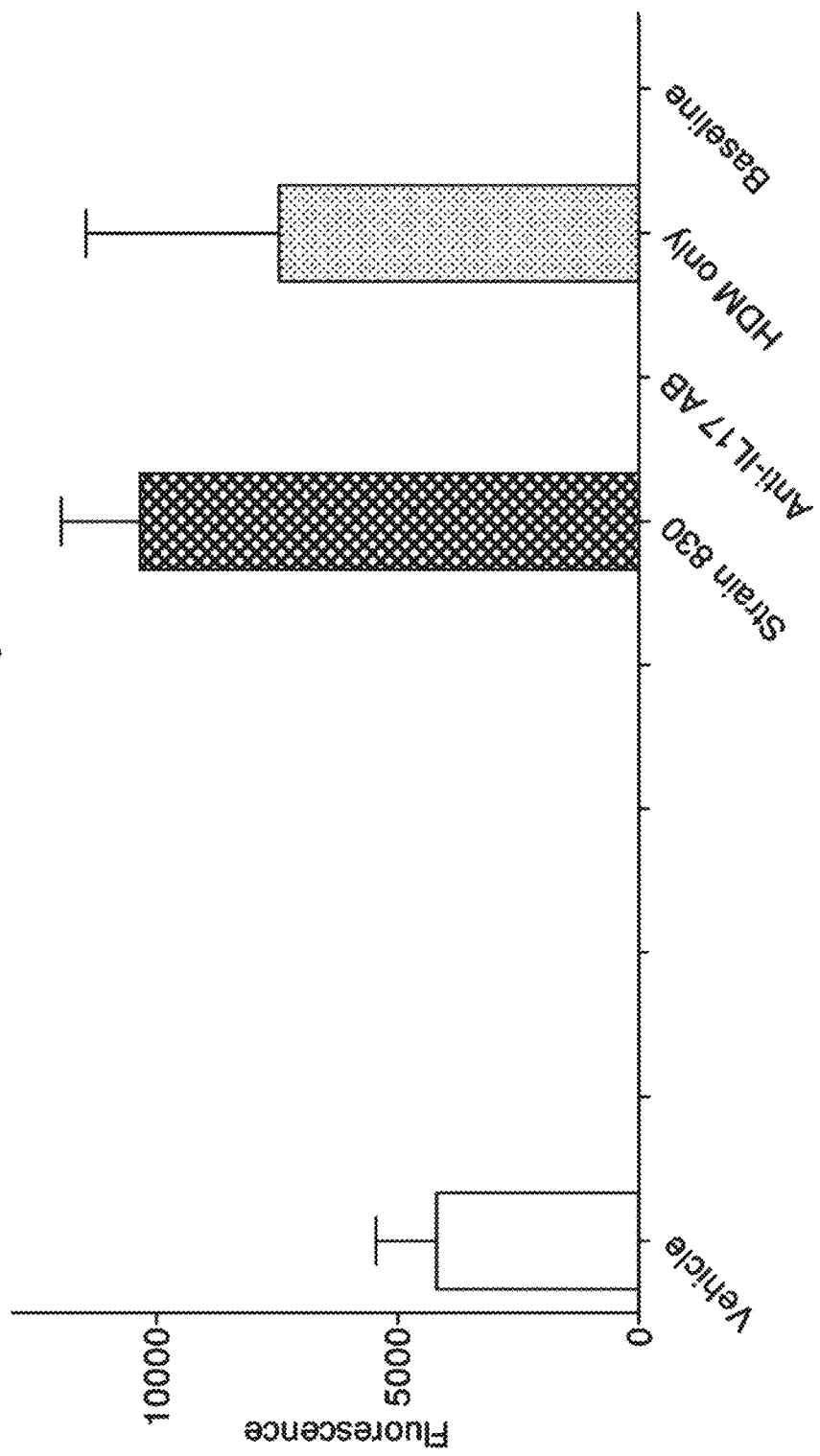
FIG. 61: Mouse model of severe neutrophilic asthma—IL-17A level in lung tissue
Figure 62:
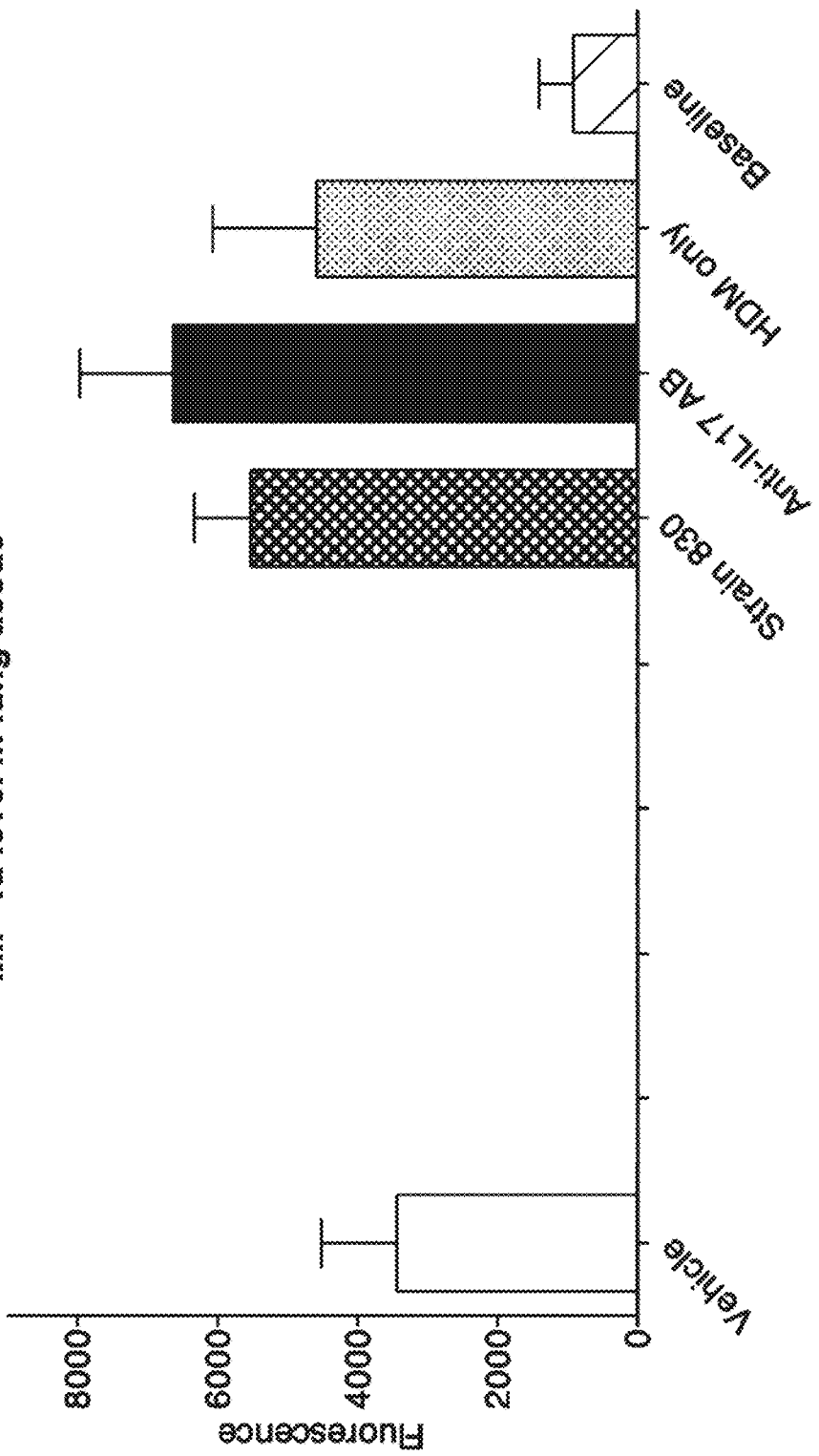
FIG. 62: Mouse model of severe neutrophilic asthma—MIP-1a level in lung tissue
Figure 63:
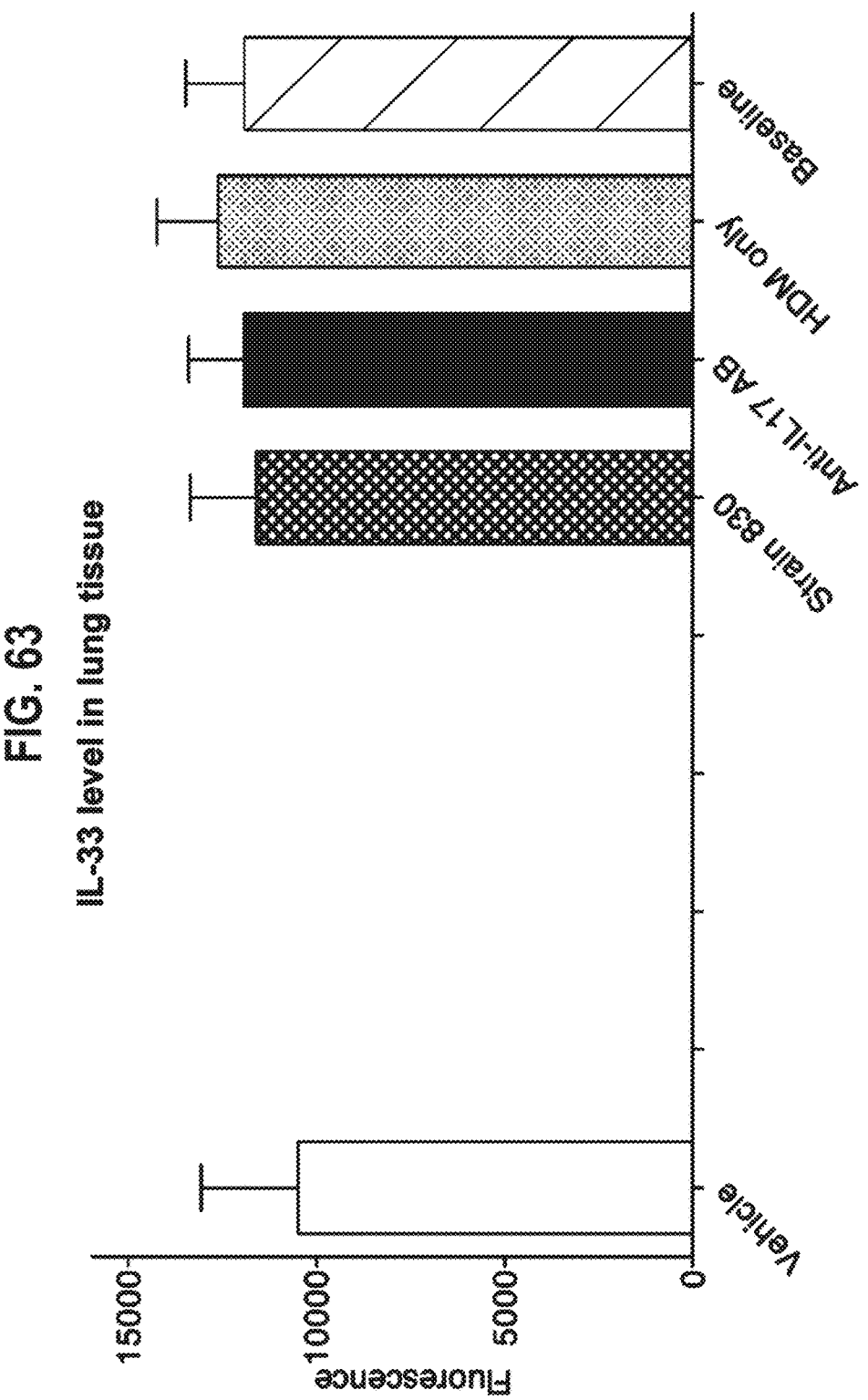
FIG. 63: Mouse model of severe neutrophilic asthma—IL-33 level in lung tissue
Figure 65:
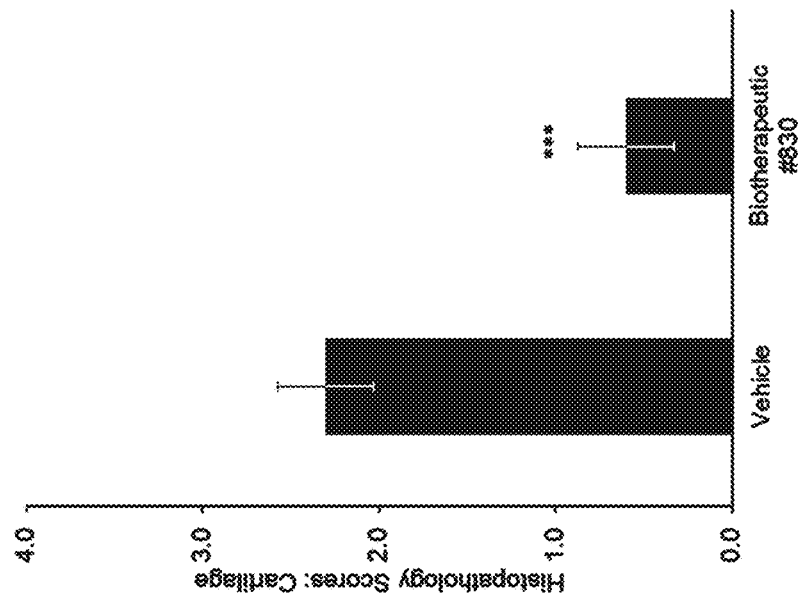
FIG. 65: Mouse model of rheumatoid arthritis—Histopathology: Inflammation Scores. Data are presented as Mean±SEM. **$p<0.01$ when compared to the vehicle-treated group.
Figure 66:
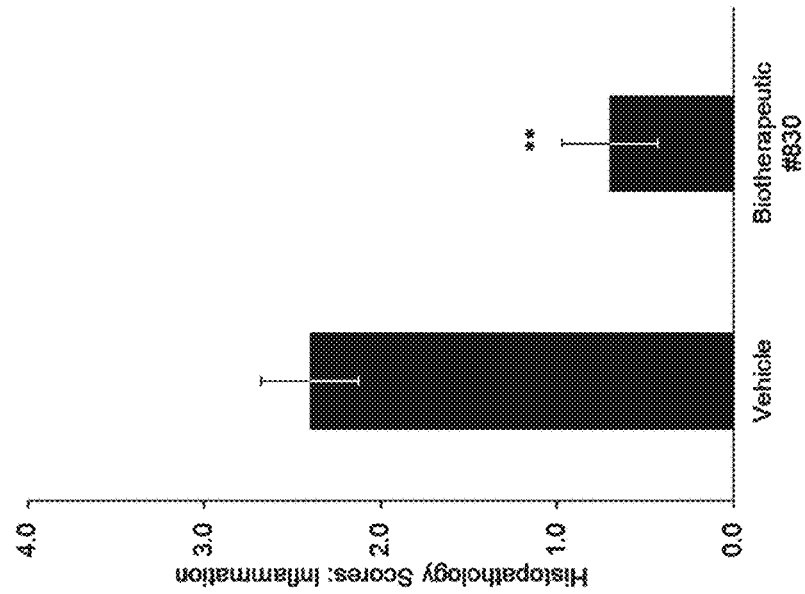
FIG. 66: Mouse model of rheumatoid arthritis—Histopathology: Cartilage Scores. Data are presented as Mean±SEM. ***$p<0.001$ when compared to the vehicle-treated group.
Figure 67:
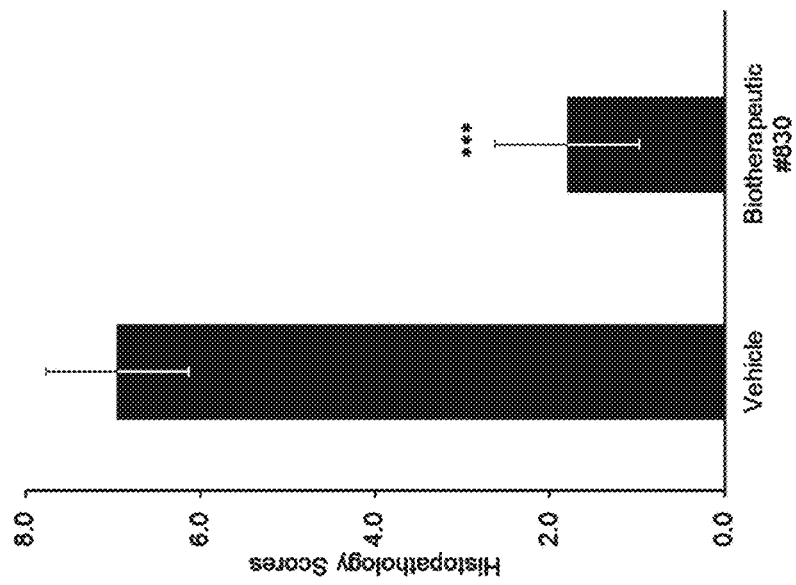
FIG. 67: Mouse model of rheumatoid arthritis—Histopathology: Bone Scores. Data are presented as Mean±SEM. ***$p<0.001$ when compared to the vehicle-treated group.
Figure 68:
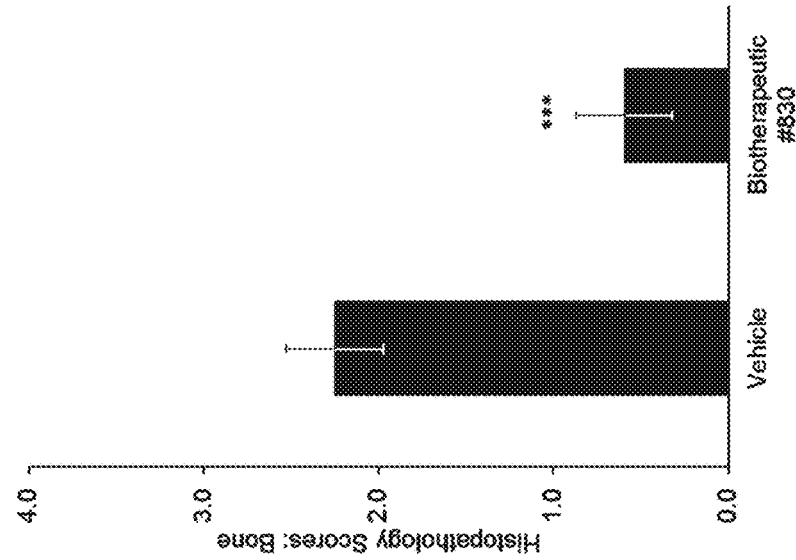
FIG. 68: Mouse model of rheumatoid arthritis—Histopathology: Total Scores. Data are presented as Mean±SEM. ***$p<0.001$ when compared to the vehicle-treated group.

With the above caveats, the data in FIG. 53 suggests that treatment with strain 830 may achieve a reduction in the levels of TNFα, which may be indicative of a mechanism of action related to influences on chemokine release (and thus recruitment of cells) by stromal or innate immune cells. TNFα is part of the Th17 pathway. Taking this dataset together, it can be concluded that strain 830 had a beneficial effect on the inflammation mechanism in this mouse model of severe neutrophilic asthma.

Example 6—Efficacy of Bacterial Inocula in a Mouse Model of Multiple Sclerosis

Summary

Mice were administered with compositions comprising bacterial strains according to the invention and the mice were subsequently immunised with myelin oligodendrocyte glycoprotein to induce experimental autoimmune encephalomyelitis (EAE). EAE is the most commonly used experimental model for human multiple sclerosis. The compositions of the invention were found to have a striking effect on disease incidence and disease severity.

Strain

830: bacteria deposited under accession number NCIMB 43281

Study Design

Groups:
1. Negative control group. Treatment with vehicle control (per oral).
5. Treatment with therapeutic bacteria inoculum strain 830 (per oral).
9. Positive control group. Treatment with Dexamethasone (i.p.).
10. Untreated Control Group.

Number of mice per group=10

Days −14 to day 27: Daily administration of vehicle control per oral (Group 1).

Days −14 to day 27: Daily administration of therapeutic bacteria inoculum per oral (Group 5).

Days 0-28: administration of Dexamethasone (i.p.) three times a week (Group 9)

Day 0: MOG35-55 (myelin oligodendrocyte glycoprotein—2 mg/ml) and CFA (2 mg/ml MTB) were mixed 1:1 resulting in 1 mg/ml solutions. 100 µl of the peptide-CFA mixture was injected subcutaneously into each hind leg. Administration of pertussis toxin intraperitoneally (300 ng).

Day 1: Administration of pertussis toxin intraperitoneally (300 ng).

Days 7-onwards: Measurement of disease incidence and weight three times a week.

Endpoints and Analysis

Mice were analysed for disease incidence and disease severity three times a week. Scoring was performed blind. Disease severity was assessed using a clinical score ranging from 0 to 5, with 5 indicating a dead mouse (see clinical scoring system below).

Monitoring

On the indicated days mice were weighed and observed for disease activity score and disease incidence.

Disease Activity Score Observations:

0—No obvious changes in motor function compared to non-immunized mice.
0.5—Tip of tail is limp.
1.0—Limp tail.
1.5—Limp tail and hind leg inhibition.
2.0—Limp tail and weakness of hind legs.
  OR—There are obvious signs of head tilting when the walk is observed. The balance is poor.
2.5—Limp tail and dragging of hind legs.
  OR—There is a strong head tilt that causes the mouse to occasionally fall over.
3.0—Limp tail and complete paralysis of hind legs.
3.5—Limp tail and complete paralysis of hind legs.
  In addition to: Mouse is moving around the cage, but when placed on its side, is unable to right itself.
  Hind legs are together on one side of body.
4.0—Limp tail, complete hind leg and partial front leg paralysis.
  Mouse is minimally moving around the cage but appears alert and feeding
4.5—Complete hind and partial front leg paralysis, no movement around the cage.
  Mouse is immediately euthanized and removed from cage.
5.0 Mouse is euthanized due to severe paralysis.

When an animal has equal or greater disease activity score of 1, it is considered to have a positive disease incidence score.

Results

Figure 70:
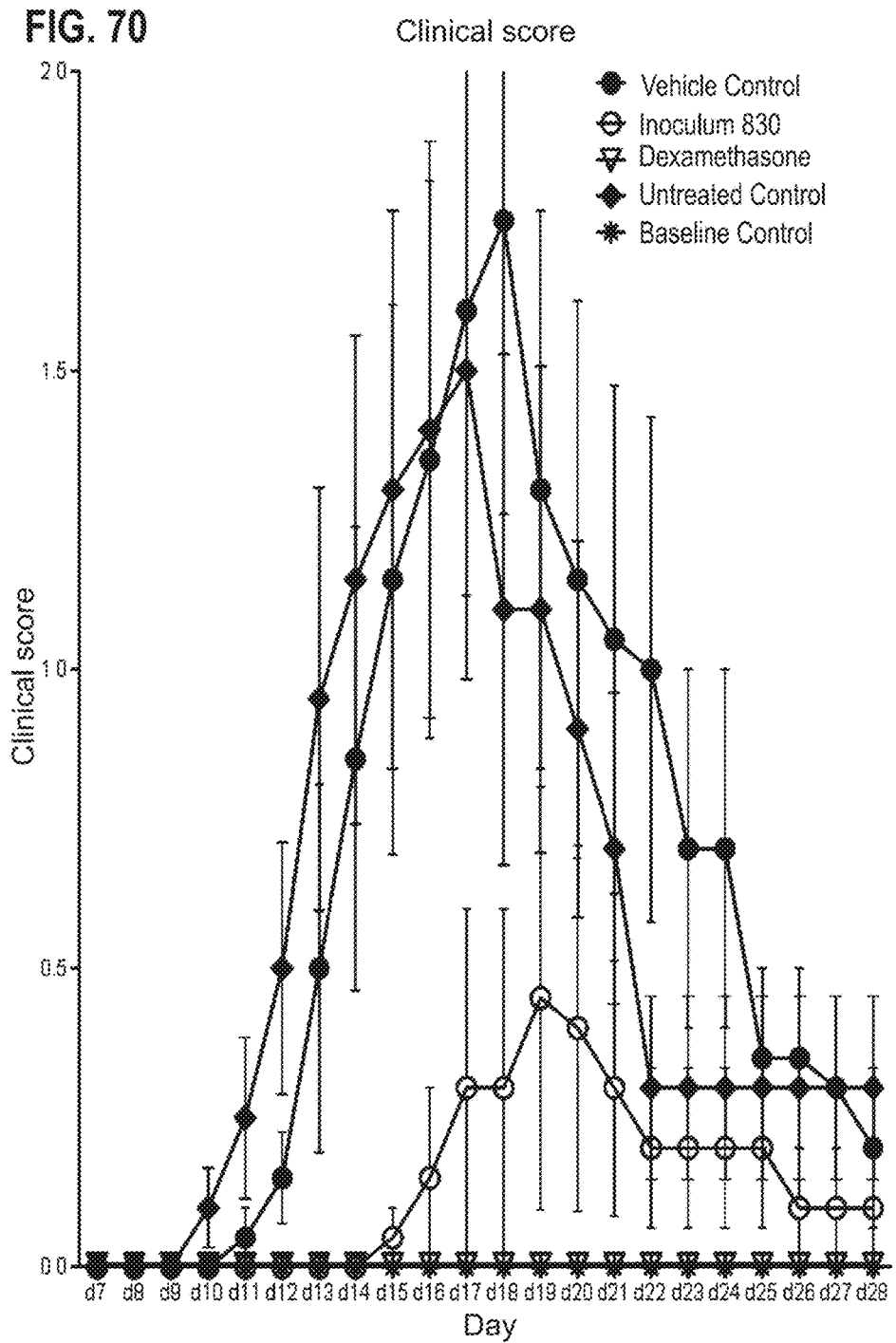
FIG. 70: Mouse model of multiple sclerosis—clinical score.
Figure 71:
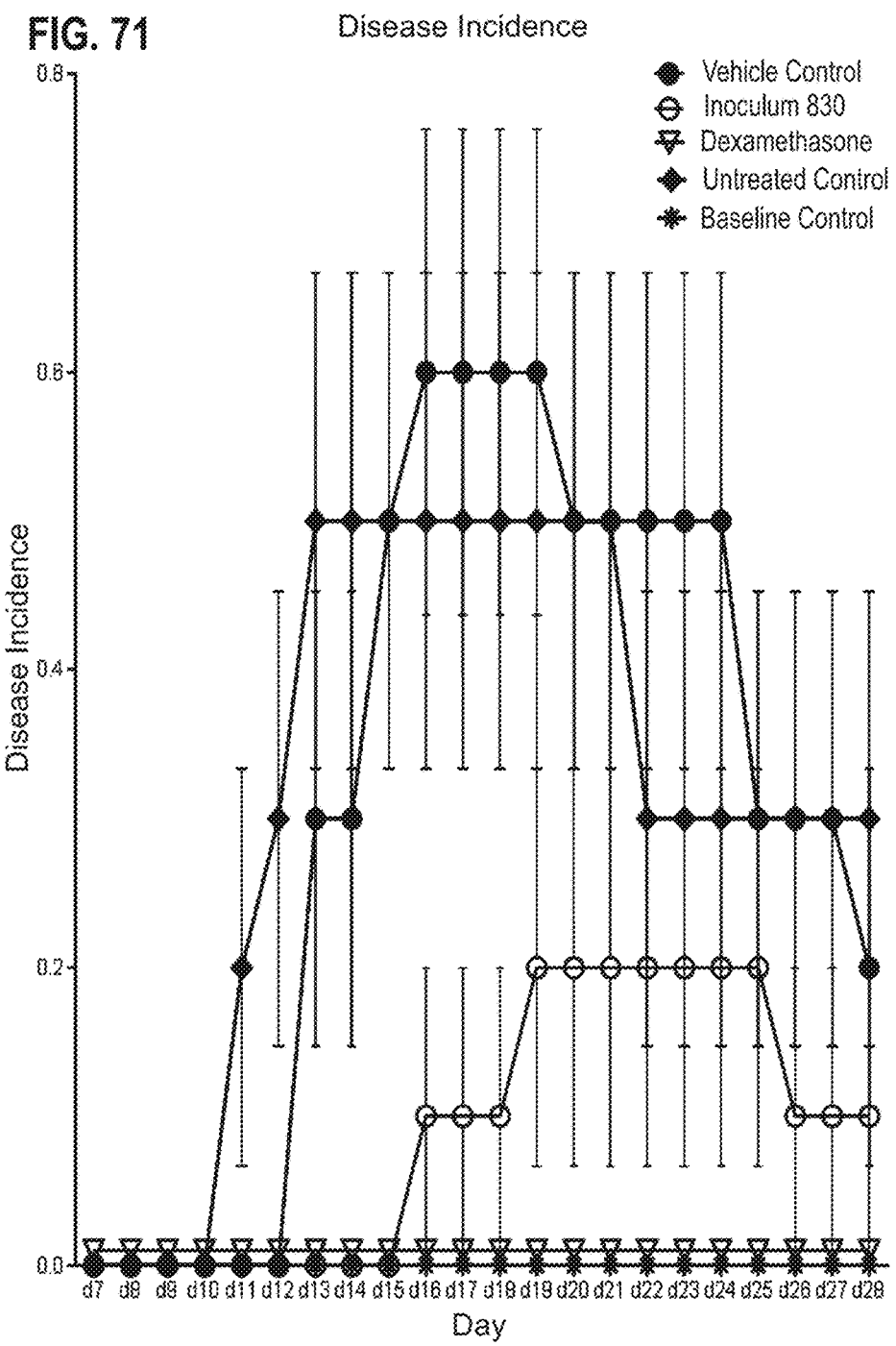
FIG. 71: Mouse model of multiple sclerosis—disease incidence.

The results of the study are shown in FIGS. 70 and 71.

Disease induction in the negative control groups was successful with high scores shown by the vehicle control and the untreated control. The effect of treatment with strain 830 was striking and the mice treated with strain 830 exhibited notably reduced disease incidence and disease severity. Indeed, the reduction in disease incidence and disease severity was comparable to the positive control group. These data indicate the strain 830 may be useful for treating or preventing multiple sclerosis.

Example 7—Efficacy of Bacterial Inocula in a Mouse Model of Uveitis

Summary

This study used a mouse model of interphotoreceptor retinoid-binding protein (IRBP)-induced uveitis to test the effects of bacterial administration on uveitis. Uveitis is a sight-threatening condition resulting from intraocular inflammation and retinal tissue destruction. This disease can be studied in rodents in a model of experimental autoimmune uveoretinitis (EAU) [70]. EAU is an organ-specific disorder where Th1/Th17 cells are directed toward retinal antigens and produce cytokines that activate resident and infiltrating mononuclear cells leading to tissue destruction. EAU can be induced in mice by challenge with retinal antigens including interphotoreceptor retinoid binding protein peptide (IRBPp). Disease onset normally occurs from day 8-9 and peaks after days 14-15. Signs of clinical disease can be monitored using topical endoscopic fundal imaging (TEFI).

Strain

MRX008: *Blautia wexlerae*, bacteria deposited under accession number NCIMB 42486.

Biotherapeutic was provided in glycerol stock. Microbiological growth media (YCFA) was used for the culture of the agent.

Mice

The mice were strain C57BL/6 and were over 6 weeks old at the beginning of the study. 72 mice were used (+36 Satellite animals). Unhealthy animals were excluded from the study. Animals were housed in specific pathogen free (spf) conditions, in a thermostatically monitored holding room (22±4° C.). Animals were allowed to acclimatise under standard animal house conditions for a minimum of one week prior to use. The health status of the animals was monitored throughout this period and the suitability of each animal for experimental use was assessed prior to study start. Mice were housed in groups of up to 10 animals per cage for the duration of the study. Irradiated pellet diet (Lab diet, EU Rodent diet 22%, 5LF5) and water were available ad libitum throughout the acclimatisation and study periods. It is unlikely that any constituent of the diet or water interfered with the study.

Experimental Outline

Adult female C57BL/6 mice were randomly allocated to experimental groups and allowed to acclimatise for one week. Treatments were administered according to the schedule below. On Day 0, animals were administered with an emulsion containing 200 µg of interphotoreceptor retinoid binding protein peptide 1-20 (IRBP p1-20) in complete Freund's adjuvant (CFA) supplemented with 2.5 mg/ml *Mycobacterium Tuberculosis* H37 Ra by subcutaneous injection. Also on Day 0, animals were administered with 1.5 µg *Bordetella Pertussis* toxin by intra-peritoneal injection. From Day −14, animals are weighed three times per week. From Day −1 until the end of the experiment on Day 42, animals are monitored twice per week for clinical signs of uveitis using topical endoscopic fundal imaging (TEFI).

Administration Schedule

All Groups are n=12

Vehicle for oral administration is YCFA medium.

Administration volume for twice daily oral administration is 5 ml/kg.

| Group | Treatment | Dose | Route | Frequency | Disease Induction |
|---|---|---|---|---|---|
| 1 | Vehicle | 5 ml/kg | PO | BID | Day 0: IRBP/CFA, SC |
| 2 | MRX008 | 5 ml/kg | | Day-14-End | Day 0: PTx, IP |

PO: oral administration,
BID: twice daily,
SC: subcutaneous injection,
IP: intra-peritoneal injection,
IRBP: interphotoreceptor binding protein,
CFA: complete Freund's adjuvant,
PTx: Pertussis toxin A positive control group was also tested using treatment with the drug cyclosporin A.

Readouts

Bodyweights.

From Day −14, animals are weighed three times a week. Animals with a bodyweight loss equal to or greater than 15% of their initial (Day 0) bodyweight on two consecutive occasions are culled.

Non-Specific Clinical Observations.

From Day −14 until the end of the experiment, animals are checked daily for non-specific clinical signs to include abnormal posture (hunched), abnormal coat condition (piloerection) and abnormal activity levels (reduced or increased activity).

Clinical Scores: Retinal Imaging by Topical Endoscopic Fundal Imaging (TEFI).

From Day −1 until the end of the experiment, animals are scored twice per week for clinical signs of uveitis. Retinal images are captured using TEFI in non-anaesthetised but restrained animals following pupil dilatation using Tropicamide 1% then Phenylephrine hydrochloride 2.5%. Retinal images are scores using the following system. The maximum cumulative score is 20.

Results

Figure 72:
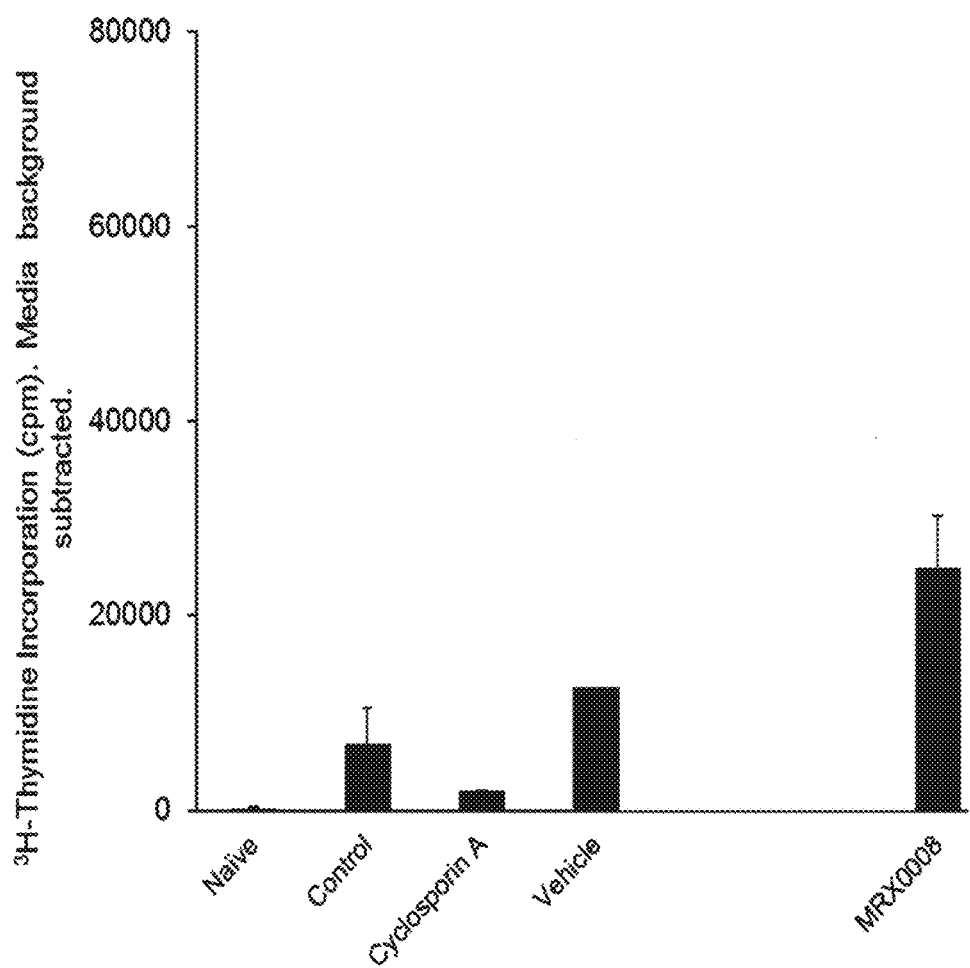
FIG. 72: Mouse model of uveitis—Lymph node proliferative response to IRBP peptide. Media background subtracted [IRBP peptide stimulated—media background] counts per minute based on 3H-thymidine incorporation. All data are presented as Mean+SEM (n=3).
Figure 73:
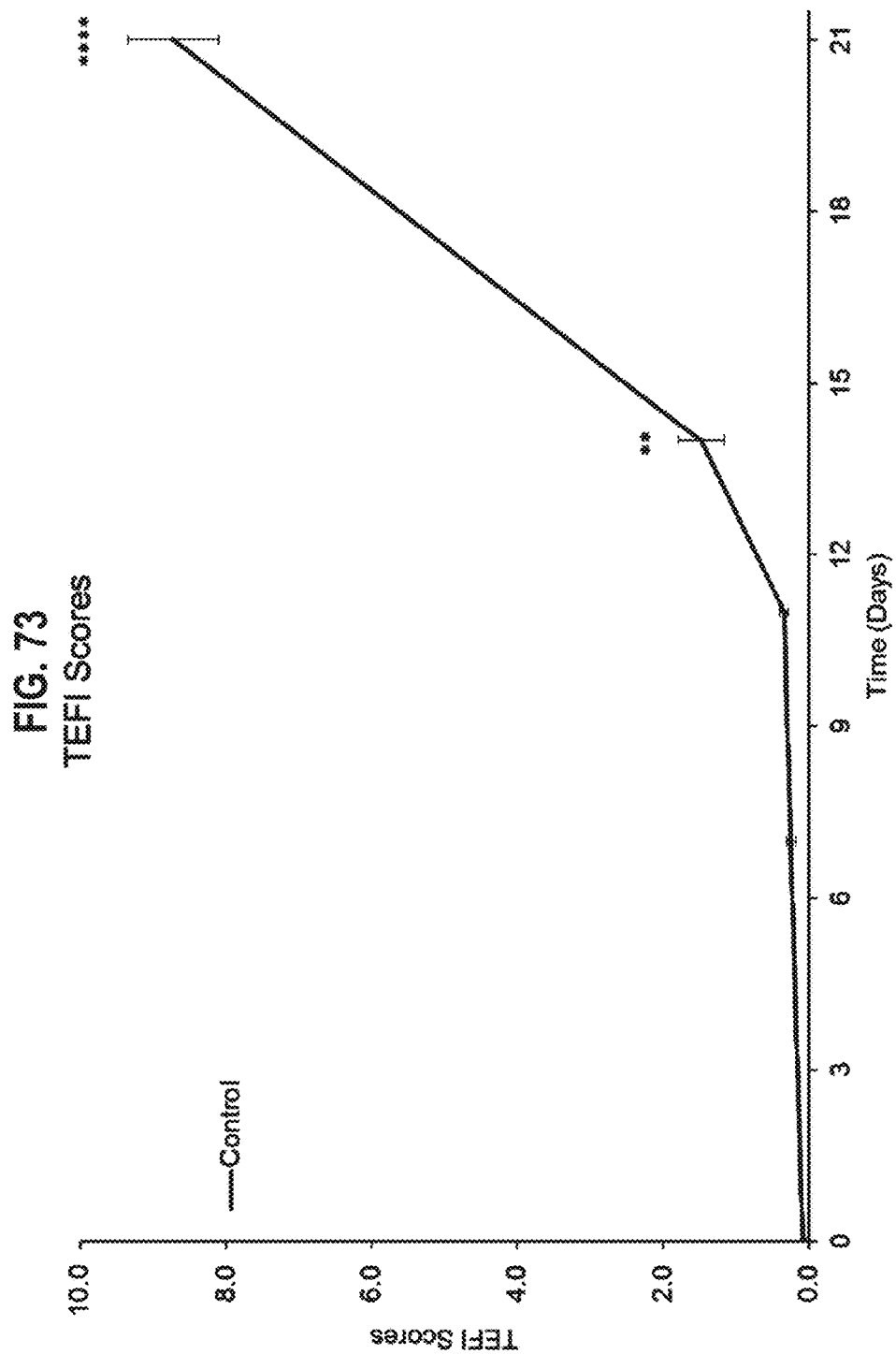
FIG. 73: Mouse model of uveitis—TEFI Scores in the control group. Data are presented as Mean±SEM.
Figure 74:
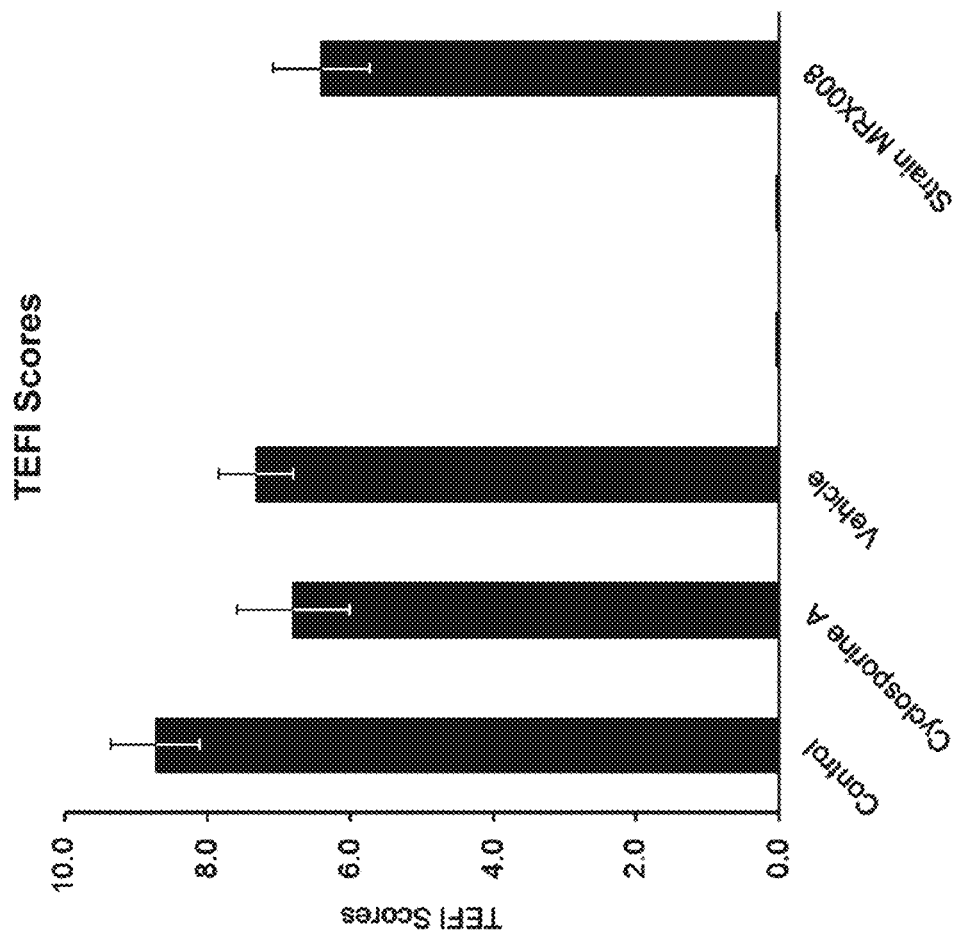
FIG. 74: Mouse model of uveitis—TEFI Scores on Day 21. Data are presented as Mean±SEM.

The results of the study are shown in FIGS. 72-74.

Cell Proliferation (Satellite Animals, Day 21).

Draining lymph nodes (DLN) were removed and cells were isolated. After counting, cells were cultured for 72 h in the presence or absence of IRBP peptide. Supernatants for cytokine analysis were removed prior to pulsing with 3H-Thymidine. Cells were then cultured for a further 18 h prior to harvesting and determination of proliferation by incorporation of 3H-thymidine using a beta-counter.

The groups showed cell proliferation to IRBP stimulus above that seen in the media control wells (these background values were subtracted from the IRBP result to provide data as Δcpm). Both groups gave strong proliferative responses to a positive control stimulus (anti-CD3/CD28) showing cells in culture were viable and able to proliferate (data not shown).

Proliferative responses to IRBP peptide were analysed by one-way ANOVA followed by Dunnett's post-test for comparison of stimulated responses in the experimental group with the control group.

Proliferative responses to IRBP peptide in disease control animals were of the magnitude expected for this model. The positive control drug, Cyclosporin A, reduced proliferation, although this reduction did not achieve statistical significance (FIG. 72).

The treatment groups (including vehicle alone) showed non-significantly increased proliferation above that seen in control animals.

Proliferative responses to IRBP peptide were analysed by one-way ANOVA followed by Dunnett's post-test for comparison of stimulated responses in treatment groups with the vehicle group. No statistical differences were seen.

Clinical Scores: Retinal Imaging by Topical Endoscopic Fundal Imaging (TEFI).

TEFI scores data measured in the Control group from Day 0 until Day 21 were analysed by Kruskal-Wallis test for non-parametric data followed by Dunn's post-test for multiple comparisons between experimental days.

IRBP administration induced a significant increase in the TEFI scores measured from Day 14 ($p<0.01$) and on Day 21 ($p<0.0001$) when compared to Day 0 in the Control group (FIG. 73).

TEFI scores data measured in all experimental groups on Day 21 were analysed by Kruskal-Wallis test for non-

| Score | Optic disc Inflammation | Retinal vessels | Retinal tissue Infiltration | Structural damage |
|---|---|---|---|---|
| 1 | Minimal | 1-4 mild cuffings | 1-4 small lesions or 1 linear lesion | Retinal lesions or atrophy involving ¼ to ¾ of retinal area |
| 2 | Mild | >4 mild cuffings or 1-3 moderate cuffings | 5-10 small lesions or 2-3 linear lesions | Panretinal atrophy with multiple small lesions (scars) or ≤3 linear lesions (scars) |
| 3 | Moderate | >3 moderate cuffings | >10 small lesions or >3 linear lesions | Panretinal atrophy with >3 linear lesions or confluent lesions (scars) |
| 4 | Severe | >1 severe cuffings | Linear lesion confluent | Retinal detachment with folding |
| 5 | | | Not visible (white-out or severe detachment) | | parametric data followed by Dunn's post-test for multiple comparisons between experimental groups.

At this stage in the experiment, there was no significant difference between experimental groups, but TEFI scores were lower in the MRX008 treated group than in the negative control groups. Indeed, TEFI scores were lower in the MRX008 treated group than in the positive control, cyclosporin A treated group.

Conclusions

Proliferative responses to IRBP peptide were seen in lymph node cultures from all experimental groups, excluding naïve animals, indicating successful disease induction. Clinical scores determined by TEFI increased from Day 14, as expected in this model of IRBP-induced uveitis. By Day 21, significant differences between experimental groups are not yet visible, but a striking reduction in disease incidence and disease severity was observed in the MRX008 treated group, which was a greater reduction than seen for the positive control group. In particular, these data indicate that treatment with the strain MRX008 reduced retinal damage, optic disc inflammation and/or retinal tissue infiltration by inflammatory cells (see TEFI retinal image scoring system above). These data indicate the strain MRX008 may be useful for treating or preventing uveitis.

Example 8—Efficacy of Bacterial Inocula of MRX006 in an LPS-Induced Inflammatory Model—Reduced Cytokine Concentration Summary The bacterial strain MRX006 (830) was tested in an anti-inflammatory assay (n=9) to determine its effect on cytokine concentrations. Inflammation was induced using a well-established trigger of the inflammatory response, lipopolysaccharide (LPS). The magnitude and characteristics of the inflammatory response in the MRX006 (830) treated groups was compared to control groups. The compositions of the invention were found to alleviate the inflammatory response, and in particular to reduce the concentration of the cytokines IL-6 and TNFα. The data therefore indicate that the compositions of the invention have a broad inflammatory phenotype and may be useful for treating inflammatory diseases, such as neutrophilia and asthma.

Results and Analysis

Figure 75:
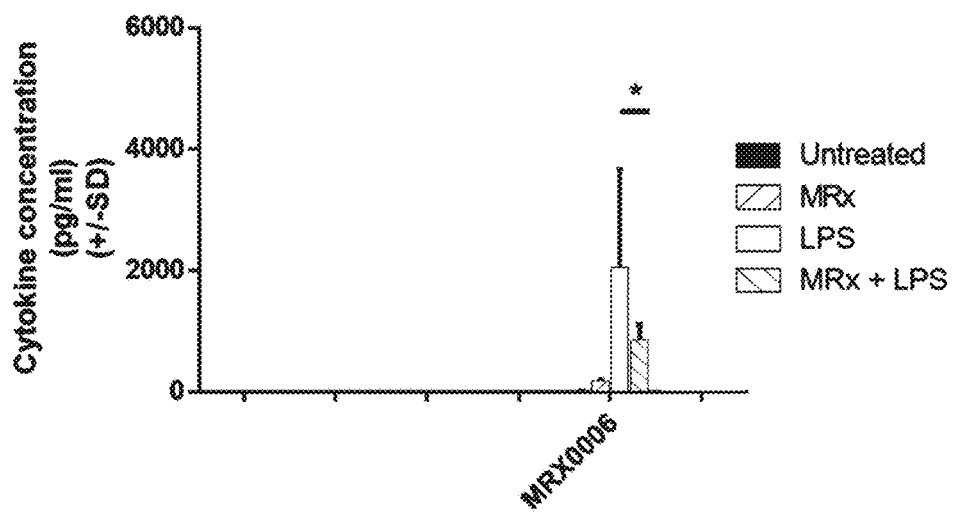
FIG. 75: LPS-induced inflammatory assay—IL-6 levels
Figure 76:
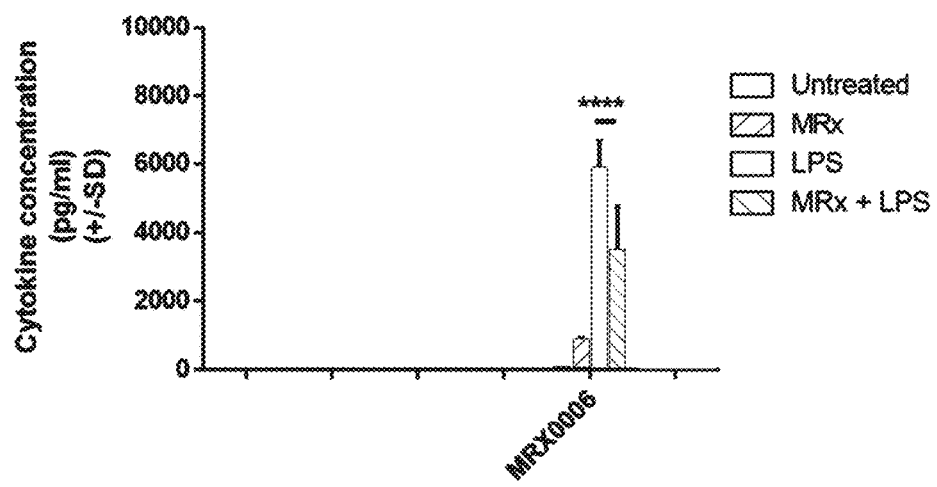
FIG. 76: LPS-induced inflammatory assay—TNF a levels

The results of the experiment are shown in FIGS. 75 and 76.

As shown in FIGS. 75 and 76, respectively, the administration of LPS causes an increase in IL-6 and TNFα levels, as would be expected after induction of inflammation. Importantly, the levels of these cytokines is significantly reduced in the groups treated with MRX006 (830). Therefore, the compositions of the invention reduce the concentration of inflammatory cytokines and therefore have a broad anti-inflammatory phenotype.

Example 9—Efficacy of Bacterial Inocula of MRX006 in an LPS-Induced Inflammatory Model—Reduced Monocyte Derived Dendritic Cells (Mo-DC) Maturation Summary The bacterial strain MRX006 (830) was tested in an anti-inflammatory assay involving the detection of the extent of the maturation of monocyte-derived dendritic cells (Mo-DCs). These cells, particularly the CD1a+CD14− cells as used in this example, are involved in the inflammatory response upon maturation. Maturation of CD1a+CD14− cells is indicated by their increased expression of CD80, CD83, CD86 and HLA-DR. The compositions of the invention were found to alleviate the inflammatory response, and in particular to reduce the maturation of dendritic cells associated with the inflammatory response (CD1a+CD14−). The data therefore indicate that the compositions of the invention may be useful for treating inflammatory diseases, such as neutrophilia and asthma.

Results and Analysis

Figure 77:
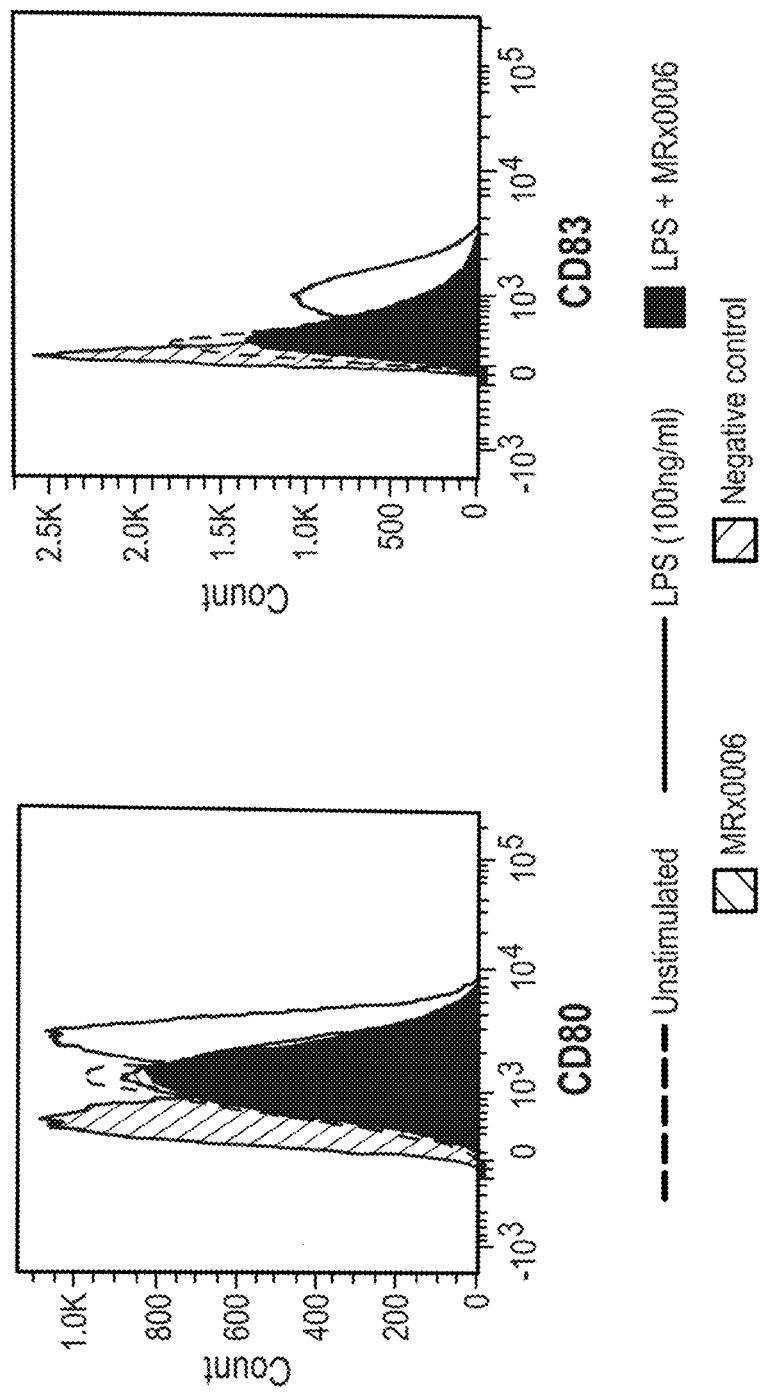
FIG. 77: LPS-induced inflammatory assay—level of Mo-DC maturation

The results of the experiment are shown in FIG. 77.

As shown in FIG. 77, the administration of LPS causes an increase in the expression of markers of maturation on the MoDCs, as indicated by the shift of the black line to the right of the graph. Importantly, the level of expression of maturation markers is reduced in the LPS group treated with MRX006 (as indicated by the shift of the black filled line to the left). For the LPS+MRX006 group, the level of expression of the CD80, CD83 and HLA-DR inflammatory markers returns to the level of expression in the unstimulated control (dashed line). Additionally, the level of expression of CD86 in the LPS+MRX006 group is also greatly reduced compared to the LPS alone group. Thus, the compositions of the invention reduce the level of maturation of MoDCs associated with inflammation, and therefore have a broad anti-inflammatory phenotype.

Example 10—Efficacy of Bacterial Inocula in a Mouse Model of Ovalbumin-Induced Inflammatory Model—Reduced CD4+ Cell Division Summary The bacterial strain MRX006 (830) was tested in an additional inflammatory assay (n=5) involving the detection of the level of CD4+ cells. Increased CD4+ cell levels is an indicator of inflammation. One of the reasons for this is that CD4+ cells are involved in the Th17 and IL-17 inflammatory pathways. Inflammation was induced using a well-established trigger of the inflammatory response, ovalbumin. The compositions of the invention were found to alleviate the inflammatory response, and in particular to reduce the number of CD4+ cells. The data therefore indicate that the compositions of the invention may be useful for treating inflammatory diseases, such as neutrophilia and asthma.

Results and Analysis

Figure 78:
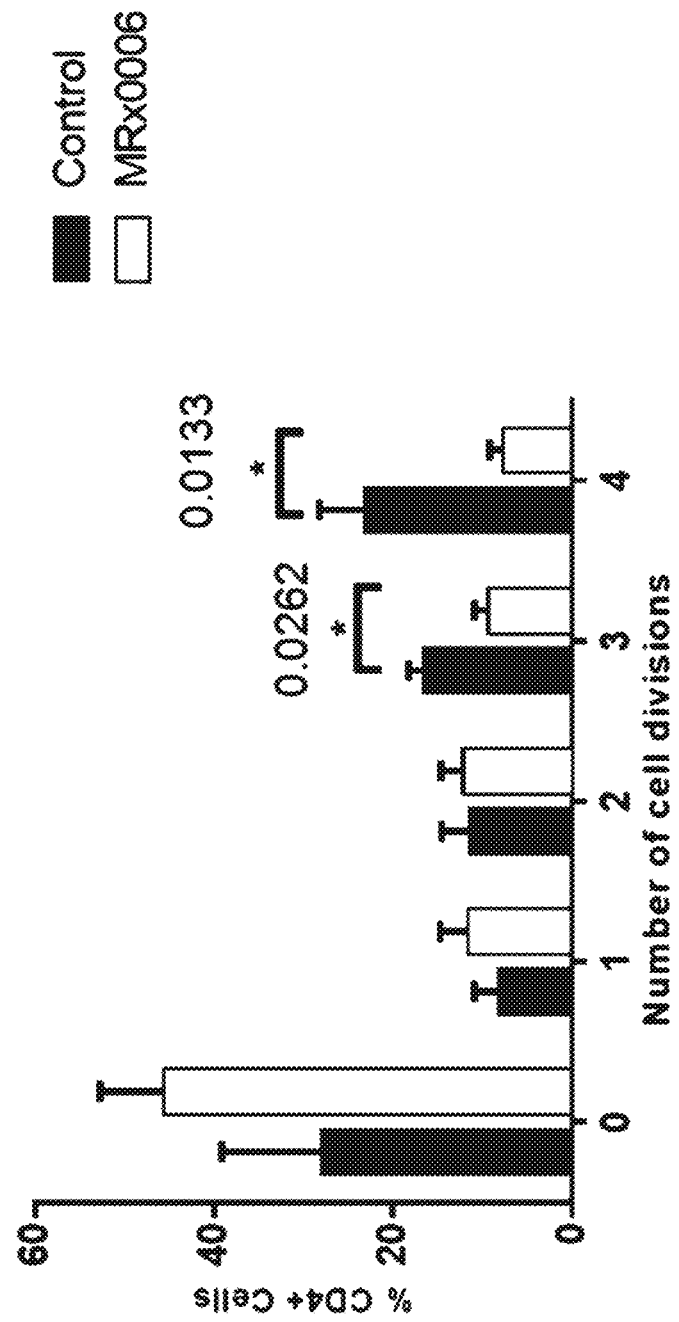
FIG. 78: Ovalbumin-induced inflammatory assay—CD4+ cell levels

The results of the experiment are shown in FIG. 78.

As shown in FIG. 78, the number of CD4+ cells in the population undergoing three or more cell divisions is increased after challenge with ovalbumin (as would be expected upon an inflammatory response). Critically, the number of cells undergoing three or more divisions after challenge with ovalbumin is significantly reduced in groups treated with MRX006. Therefore, the compositions of invention reduce CD4+ cell levels and thus, invention may be useful for treating inflammatory diseases, such as neutrophilia and asthma.

Example 11—Stability Testing

A composition described herein containing at least one bacterial strain described herein is stored in a sealed container at 25° C. or 4° C. and the container is placed in an atmosphere having 30%, 40%, 50%, 60%, 70%, 75%, 80%, 90% or 95% relative humidity. After 1 month, 2 months, 3 months, 6 months, 1 year, 1.5 years, 2 years, 2.5 years or 3 years, at least 50%, 60%, 70%, 80% or 90% of the bacterial strain shall remain as measured in colony forming units determined by standard protocols.

Sequences

SEQ ID NO: 1 (*Blautia stercoris* strain GAM6-1 16S ribosomal RNA gene, partial sequence-1-HM626177)

```
   1   tgcaagtcga gcgaagcgct tacgacagaa ccttcggggg aagatgtaag ggactgagcg
  61   gcggacgggt gagtaacgcg tgggtaacct gcctcataca gggggataac agttggaaac
 121   ggctgctaat accgcataag cgcacggtat cgcatgatac agtgtgaaaa actccggtgg
 181   tatgagatgg acccgcgtct gattagctag ttggaggggt aacggcccac caaggcgacg
 241   atcagtagcc ggcctgagag ggtgaacggc cacattggga ctgagacacg gcccagactc
 301   ctacggggagg cagcagtggg gaatattgca caatggggga aaccctgatg cagcgacgcc
 361   gcgtgaagga agaagtatct cggtatgtaa acttctatca gagggaaga aaatgacggt
 421   acctgactaa gaagccccgg ctaactacgt gccagcagcc gcggtaatac gtaggggca
 481   agcgttatcc ggatttactg ggtgtaaagg gagcgtagac ggaagagcaa gtctgatgtg
 541   aaaggctggg gcttaacccc aggactgcat tggaaactgt ttttcttgag tgccggagag
 601   gtaagcggaa ttcctagtgt agcggtgaaa tgcgtagata ttaggaggaa caccagtggc
 661   gaaggcggct tactggacgg taactgacgt tgaggctcga agcgtgggg agcaaacagg
 721   attagatacc ctggtagtcc acgccgtaaa cgatgaatac taggtgttgg ggagcaaagc
 781   tcttcggtgc cgcagcaaac gcaataagta ttccacctgg ggagtacgtt cgcaagaatg
 841   aaactcaaag gaattgacgg ggacccgcac aagcggtgga gcatgtggtt taattcgaag
 901   caacgcgaag aaccttacca agtcttgaca tcgatctgac cggttcgtaa tggaacctt
 961   ccttcgggac agagaagaca ggtggtgcat ggttgtcgtc agctcgtgtc gtgagatgtt
1021   gggttaagtc ccgcaacgag cgcaaccccct atcctcagta gccagcaggt gaagctgggc
1081   actctgtgga gactgccagg gataacctgg aggaaggcgg ggacgacgtc aaatcatcat
1141   gccccttatg atttgggcta cacacgtgct acaatggcgt aaacaaaggg aagcgagccc
1201   gcgaggggga gcaaatccca aaaataacgt cccagttcgg actgcagtct gcaactcgac
1261   tgcacgaagc tggaatcgct agtaatcgcg aatcagaatg tcgcggtgaa tacgttcccg
1321   ggtcttgtac acaccgcccg tcacaccatg ggagtcagta acgcccgaag tc
```

SEQ ID NO: 2 (consensus 16S rRNA sequence for *Blautia stercoris* strain 830)
TTTKGTCTGGCTCAGGATGAACGCTGGCGGCGTGCTTAACACATGCAAGTCGAGCGAAGCGCTTACGACAGAACCTT
CGGGGGAAGATGTAAGGGACTGAGCGGCGGACGGGTGAGTAACGCGTGGGTAACCTGCCTCATACAGGGGGATAACA
GTTGGAAACGGCTGCTAATACCGCATAAGCGCACAGTATCGCATGATACAGTGTGAAAAACTCCGGTGGTATGAGAT
GGACCCGCGTCTGATTAGCTAGTTGGAGGGGTAACGGCCCACCAAGGCGACGATCAGTAGCCGGCCTGAGAGGGTGA
ACGGCCACATTGGGACTGAGACACGGCCCAGACTCCTACGGGAGGCAGCAGTGGGGAATATTGCACAATGGGGGAAA
CCCTGATGCAGCGACGCCGCGTGAAGGAAGAAGTATCTCGGTATGTAAACTTCTATCAGCAGGGAAGAAATGACGG
TACCTGACTAAGAAGCCCCGGCTAACTACGTGCCAGCAGCCGCGGTAATACGTAGGGGGCAAGCGTTATCCGGATTT
ACTGGGTGTAAAGGGAGCGTAGACGGAAGAGCAAGTCTGATGTGAAAGGCTGGGGCTTAACCCCAGGACTGCATTGG
AAACTGTTTTTCTTGAGTGCCGGAGAGGTAAGCGGAATTCCTAGTGTAGCGGTGAAATGCGTAGATATTAGGAGGAA
CACCAGTGGCGAAGGCGGCTTACTGGACGGTAACTGACGTTGAGGCTCGAAAGCGTGGGGAGCAAACAGGATTAGAT
ACCCTGGTAGTCCACGCCGTAAACGATGAATACTAGGTGTTGGGGAGCAAAGCTCTTCGGTGCCGCAGCAAACGCAA
TAAGTATTCCACCTGGGGAGTACGTTCGCAAGAATGAAACTCAAAGGAATTGACGGGGACCCGCACAAGCGGTGGAG
CATGTGGTTTATTCGAAGCAACGCGAAGAACCTTACCAAGTCTTGACATCGATCTGACCGGTTCGTAATGGAACCTT
TCCTTCGGGACAGAGAAGACAGGTGGTGCATGGTTGTCGTCAGCTCGTGTCGTGAGATGTTGGGTTAAGTCCCGCAA
CGAGCGCAACCCCTATCGTCAGTAGCCAGCAGGTAAAGCTGGGCACTCTGAGGAGACTGCCAGGGATAACCTGGAGG
AAGGCGGGGACGACGTCAAATCATCATGCCCCTTATGATTTGGGCTACACACGTGCTACAATGGCGTAAACAAAGGG
AAGCGAGCCCGCGAGGGGGAGCAAATCCCAAAAATAACGTCCCAGTTCGGACTGCAGTCTGCAACTCGACTGCACGA
AGCTGGAATCGCTAGTAATCGCGAATCAGAATGTCGCGGTGAATACGTTCCCGGGTCTTGTACACACCGCCCGTCAC
ACCATGGGAGTCAGTAACGCCCGAAGTCAGTGACCCAACCTTAGGGAGGGAGCTGCCGAAGGCGGGATTGATAACTG
GGGTGAAGTCTAGGGGGT SEQ ID NO: 3 (*Blautia wexlerae* strain WAL 14507 16S ribosomal RNA gene, partial sequence-EF036467)

```
   1   caagtcgaac gggaattant ttattgaaac ttcggtcgat ttaatttaat tctagtggcg
  61   gacgggtgag taacgcgtgg gtaacctgcc ttatacaggg ggataacagt cagaaatggc
 121   tgctaatacc gcataagcgc acagagctgc atggctcagt gtgaaaaact ccggtggtat
 181   aagatggacc cgcgttggat tagcttgttg gtggggtaac ggcccaccaa ggcgacgatc
```

-continued

| | Sequences |
|---|---|
| 241 | catagccggc ctgagagggt gaacggccac attgggactg agacacggcc cagactccta |
| 301 | cgggaggcag cagtggggaa tattgcacaa tggggggaaac cctgatgcag cgacgccgcg |
| 361 | tgaaggaaga agtatctcgg tatgtaaact tctatcagca gggaagatag tgacggtacc |
| 421 | tgactaagaa gccccggcta actacgtgcc agcagccgcg gtaatacgta gggggcaagc |
| 481 | gttatccgga tttactgggt gtaaagggag cgtagacggt gtggcaagtc tgatgtgaaa |
| 541 | ggcatgggct caacctgtgg actgcattgg aaactgtcat acttgagtgc cggaggggta |
| 601 | agcggaattc ctagtgtagc ggtgaaatgc gtagatatta ggaggaacac cagtggcgaa |
| 661 | ggcggcttac tggacggtaa ctgacgttga ggctcgaaag cgtggggagc aaacaggatt |
| 721 | agataccctg gtagtccacg ccgtaaacga tgaataacta ggtgtcgggt ggcaaagcca |
| 781 | ttcggtgccg tcgcaaacgc agtaagtatt ccacctgggg agtacgttcg caagaatgaa |
| 841 | actcaaagga attgacgggg acccgcacaa gcggtggagc atgtggttta attcgaagca |
| 901 | acgcgaagaa ccttaccaag tcttgacatc cgcctgaccg atccttaacc ggatctttcc |
| 961 | ttcgggacag gcgagacagg tggtgcatgg ttgtcgtcag ctcgtgtcgt gagatgttgg |
| 1021 | gttaagtccc gcaacgagcg caaccccctat cctcagtagc cagcatttaa ggtgggcact |
| 1081 | ctggggagac tgccagggat aacctggagg aaggcgggga tgacgtcaaa tcatcatgcc |
| 1141 | ccttatgatt tgggctacac acgtgctaca atggcgtaaa caaagggaag cgagattgtg |
| 1201 | agatggagca aatcccaaaa ataacgtccc agttcggact gtagtctgca acccgactac |
| 1261 | acgaagctgg aatcgctagt aatcgcggat cagaatgccg cggtgaatac gttcccgggt |
| 1321 | cttgtacaca ccgcccgtca caccatggga gtcagtaacg cccgaagtca gtgacctaac |
| 1381 | tgcaaagaag gagctgccga aggcgggacc gatgactggg gtgaagtcgt aacaaggt |

SEQ ID NO: 4 (consensus 16S rRNA sequence for Blautia wexlerae strain MRX008)
TTCATTGAGACTTCGGTGGATTTAGATTCTATTTCTAGTGGCGGACGGGTGAGTAACGCGTGGGTAACCTGCCTTAT
ACAGGGGGATAACAGTCAGAAATGGCTGCTAATACCGCATAAGCGCACAGAGCTGCATGGCTCAGTGTGAAAAACTC
CGGTGGTATAAGATGGACCCGCGTTGGATTAGCTTGTTGGTGGGGTAACGGCCCACCAAGGCGACGATCCATAGCCG
GCCTGAGAGGGTGAACGGCCACATTGGGACTGAGACACGGCCCAGACTCCTACGGGAGGCAGCAGTGGGGAATATTG
CACAATGGGGGAAACCCTGATGCAGCGACGCCGCGTGAAGGAAGAAGTATCTCGGTATGTAAACTTCTATCAGCAGG
GAAGATAGTGACGGTACCTGACTAAGAAGCCCCGGCTAACTACGTGCCAGCAGCCGCGGTAATACGTAGGGGGCAAG
CGTTATCCGGATTTACTGGGTGTAAAGGGAGCGTAGACGGTGTGGCAAGTCTGATGTGAAAGGCATGGGCTCAACCT
GTGGACTGCATTGGAAACTGTCATACTTGAGTGCCGGAGGGGTAAGCGGAATTCCTAGTGTAGCGGTGAAATGCGTA
GATATTAGGAGGAACACCAGTGGCGAAGGCGGCTTACTGGACGGTAACTGACGTTGAGGCTCGAAAGCGTGGGGAGC
AAACAGGATTAGATACCCTGGTAGTCCACGCCGTAAACGATGAATACTAGGTGTCNGGGGAGCATGGCTCTTCGGTG
CCGTCGCAAACGCAGTAAGTATTCCACCTGGGGAGTACGTTCGCAAGAATGAAACTCAAAGGAATTGACGGGGACCC
GCACAAGCGGTGGAGCATGTGGTTTAATTCGAAGCAACGCGAAGAACCTTACCAAGTCTTGACATCCGCCTGACCGA
TCCTTAACCGGATCTTTCCTTCGGGACAGGCGAGACAGGTGGTGCATGGTTGTCGTCAGCTCGTGTCGTGAGATGTT
GGGTTAAGTCCCGCAACGAGCGCAACCCCTATCCTCAGTAGCCAGCATTTAAGGTGGGCACTCTGGGGAGACTGCCA
GGGATAACCTGGAGGAAGGCGGGGATGACGTCAAATCATCATGCCCCTTATGATTTGGGCTACACACGTGCTACAAT
GGCGTAAACAAAGGGAAGCGAGATCGTGAGATGGAGCAAATCCCAAAAATAACGTCCCAGTTCGGACTGTAGTCTGC
AACCCGACTACACGAAGCTGGAATCGCTAGTAATCGCGGATCAGAATGCCGCGGTGAATACGTTCCCGGGTCTTGTA
CACACCGCCCGTCACACCATGGGAGTCAGTAACGCCCGAAGTCAGTGACCTAACTGCAAAGAAGGAGCTGCCGAA SEQ ID NO: 5 (strain 830 chromosome sequence)-see electronic sequence listing.

SEQ ID NO: 6 (strain 830 plasmid sequence)-see electronic sequence listing.

REFERENCES

[1] Spor et al. (2011) Nat Rev Microbiol. 9(4):279-90.
[2] Eckburg et al. (2005) Science. 10; 308(5728):1635-8.
[3] Macpherson et al. (2001) Microbes Infect. 3(12):1021-35
[4] Macpherson et al. (2002) Cell Mol Life Sci. 59(12):2088-96.
[5] Mazmanian et al. (2005) Cell 15; 122(1):107-18.
[6] Frank et al. (2007) PNAS 104(34):13780-5.
[7] Scanlan et al. (2006) J Clin Microbiol. 44(11):3980-8.
[8] Kang et al. (2010) Inflamm Bowel Dis. 16(12):2034-42.
[9] Machiels et al. (2013) Gut. 63(8):1275-83.
[10] WO 2013/050792
[11] WO 03/046580
[12] WO 2013/008039
[13] WO 2014/167338
[14] Goldin and Gorbach (2008) Clin Infect Dis. 46 Suppl 2:S96-100.
[15] Azad et al. (2013) BMJ. 347:f6471.

[16] Liu et al. (2008) *Int J Syst Evol Microbiol* 58, 1896-1902.
[17] Park et al. (2012) *Int J Syst Evol Microbiol.* 62(Pt 4):776-9.
[18] Liu et al. (2008) *Int J Syst Evol Microbiol.* 58(Pt 8):1896-902.
[19] Masco et al. (2003) *Systematic and Applied Microbiology,* 26:557-563.
[20] Srůtková et al. (2011) *J. Microbiol. Methods,* 87(1):10-6.
[21] Ye et al. (2015) *PLoS One.* 10(1):e0117704.
[22] Fabro et al. (2015) *Immunobiology.* 220(1):124-35.
[23] Yin et al. (2014) *Immunogenetics.* 66(3):215-8.
[24] Cheluvappa et al. (2014) *Clin Exp Immunol.* 175(2):316-22.
[25] Schieck et al. (2014) *J Allergy Clin Immunol.* 133(3):888-91.
[26] Balato et al. (2014) *J Eur Acad Dermatol Venereol.* 28(8):1016-24.
[27] Monteleone et al. (2011) *BMC Medicine.* 2011, 9:122.
[28] Fahy (2009) *Proc Am Thorac Soc* 6.256-259
[29] Miossec and Kolls (2012) *Nat Rev Drug Discov.* 11(10):763-76.
[30] Yang et al. (2014) *Trends Pharmacol Sci.* 35(10):493-500.
[31] Koenders et al. (2006) *J. Immunol.* 176:6262-6269.
[32] Amedei et al. (2012) *Int J Mol Sci.* 13(10):13438-60.
[33] Shabgah et al. (2014) *Postepy. Dermatol. Alergol.* 31(4):256-61.
[34] Zhang (2015) *Inflammation. August 23.*
[35] Sun et al. (2015) *Cytokine.* 74(1):76-80.
[36] Mucientes et al. (2015) *Br J Ophthalmol.* 99(4):566-70.
[37] Jawad et al. (2013) *Ocul Immunol Inflamm.* 21(6):434-9.
[38] Maya et al. (2014) *J. Ophthalmology.* 310329
[39] Chi et al. (2007) *J. Allergy and Clinical Immunology.* 119(5):1218-1224.
[40] Chi et al. (2008) *Investigative Ophthalmology & Visual Science.* 49(7): 3058-3064.
[41] Luger and Caspi (2008) *Semin. Immunopathol.* 30(2): 134-143.
[42] Numasaki et al. (2003) *Blood.* 101:2620-2627.
[43] Zhang et al. (2008) *Biochem. Biophys. Res. Commun.* 374: 533-537.
[44] Karin (2006) *Nature.* 441: 431-436.
[45] Faghih et al. (2013). *Iranian Journal of Immunology.* 10(4):193-204.
[46] Numasaki et al. (2005) *J. Immunol.* 175: 6177-6189
[47] Hammerich and Tacke (2014) *Clin Exp Gasfroenterol.* 7:297-306.
[48] Miyamoto-Shinohara et al. (2008) *J. Gen. Appl. Microbiol.,* 54, 9-24.
[49] Cryopreservation and Freeze-Drying Protocols, ed. by Day and McLellan, Humana Press.
[50] Leslie et al. (1995) *Appl. Environ. Microbiol.* 61, 3592-3597.
[51] Mitropoulou et al. (2013) *J Nutr Metab.* (2013) 716861.
[52] Kailasapathy et al. (2002) *Curr Issues Intest Microbiol.* 3(2):39-48.
[53] Handbook of Pharmaceutical Excipients, 2nd Edition, (1994), Edited by A Wade and P J Weller
[54] Remington's Pharmaceutical Sciences, Mack Publishing Co. (A. R. Gennaro edit. 1985)
[55] *Handbook of Microbiological Media, Fourth Edition* (2010) Ronald Atlas, CRC Press.
[56] *Maintaining Cultures for Biotechnology and Industry* (1996) Jennie C. Hunter-Cevera, Academic Press
[57] Strobel (2009) *Methods Mol Biol.* 581:247-61.
[58] Gennaro (2000) *Remington: The Science and Practice of Pharmacy.* 20th edition, ISBN: 0683306472.
[59] *Molecular Biology Techniques: An Intensive Laboratory Course,* (Ream et al., eds., 1998, Academic Press).
[60] *Methods In Enzymology* (S. Colowick and N. Kaplan, eds., Academic Press, Inc.)
[61] *Handbook of Experimental Immunology,* Vols. I-IV (D. M. Weir and C. C. Blackwell, eds, 1986, Blackwell Scientific Publications)
[62] Sambrook et al. (2001) *Molecular Cloning: A Laboratory Manual,* 3rd edition (Cold Spring Harbor Laboratory Press).
[63] *Handbook of Surface and Colloidal Chemistry* (Birdi, K. S. ed., CRC Press, 1997)
[64] Ausubel et al. (eds) (2002) *Short protocols in molecular biology,* 5th edition (Current Protocols).
[65] *PCR (Introduction to Biotechniques Series),* 2nd ed. (Newton & Graham eds., 1997, Springer Verlag)
[66] *Current Protocols in Molecular Biology* (F. M. Ausubel et al., eds., 1987) Supplement 30
[67] Smith & Waterman (1981) *Adv. Appl. Math.* 2: 482-489.
[68] Brand et al. (2007) *Nature Protocols.* 2(5):1269-1275
[69] Jiao et al. (2014) *Immunopathology and Infectious Diseases.* 184(4):1085-93.
[70] Caspi (2003) *Curr Protoc Immunol. Chapter* 15:Unit 15.6.

SEQUENCE LISTING (7 sequences)

SEQ ID NO: 1 - DNA, 1372 bp, Blautia stercoris
tgcaagtcgagcgaagcgcttacgacagaaccttcgggggaagatgtaagggactgagcggcggacgggtgagtaacgcgtgggtaacctgcctcatacagggggataacagttggaaacggctgctaataccgcataagcgcacggtatcgcatgatacagtgtgaaaaactccggtggtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgtttttcttgagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgttggggagcaaagctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcgatctgaccggttcgtaatggaacctttccttcgggacagagaagacaggtggtgcatggttgtcgtcagctcgtgtcgtgagatgttgggttaagtcccgcaacgagcgcaacccctatcctcagtagccagcaggtgaagctgggcactctgtggagactgccagggataacctggaggaaggcggggacgacgtcaaatcatcatgccccttatgatttgggctacacacgtgctacaatggcgtaaacaaagggaagcgagcccgcgagggggagcaaatcccaaaaataacgtcccagttcggactgcagtctgcaactcgactgcacgaagctggaatcgctagtaatcgcgaatcagaatgtcgcggtgaatacgttcccgggtcttgtacacaccgcccgtcacaccatgggagtcagtaacgcccgaagtc

SEQ ID NO: 2 - DNA, 1481 bp, Blautia stercoris
tttkgtctggctcaggatgaacgctggcggcgtgcttaacacatgcaagtcgagcgaagcgcttacgacagaaccttcgggggaagatgtaagggactgagcggcggacgggtgagtaacgcgtgggtaacctgcctcatacagggggataacagttggaaacggctgctaataccgcataagcgcacagtatcgcatgatacagtgtgaaaaactccggtggtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgtttttcttgagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgttggggagcaaagctcttcggtgccgcagcaaacgcaataagtattccacctggggagtacgttcgcaagaatgaaactcaaaggaattgacggggacccgcacaagcggtggagcatgtggtttattcgaagcaacgcgaagaaccttaccaagtcttgacatcgatctgaccggttcgtaatggaacctttccttcgggacagagaagacaggtggtgcatggttgtcgtcagctcgtgtcgtgagatgttgggttaagtcccgcaacgagcgcaacccctatcgtcagtagccagcaggtaaagctgggcactctgaggagactgccagggataacctggaggaaggcggggacgacgtcaaatcatcatgccccttatgatttgggctacacacgtgctacaatggcgtaaacaaagggaagcgagcccgcgagggggagcaaatcccaaaaataacgtcccagttcggactgcagtctgcaactcgactgcacgaagctggaatcgctagtaatcgcgaatcagaatgtcgcggtgaatacgttcccgggtcttgtacacaccgcccgtcacaccatgggagtcagtaacgcccgaagtcagtgacccaaccttagggagggagctgccgaaggcgggattgataactggggtgaagtctagggggt

SEQ ID NO: 3 - DNA, 1438 bp, Blautia wexlerae
  modified_base (19)..(19): a, c, t, g, unknown or other
caagtcgaacgggaattantttattgaaacttcggtcgatttaatttaattctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagcttgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaataactaggtgtcgggtggcaaagccattcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccgcctgaccgatccttaaccggatctttccttcgggacaggcgagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagattgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggt

SEQ ID NO: 4 - DNA, 1384 bp, Blautia wexlerae
  modified_base (749)..(749): a, c, t, g, unknown or other
ttcattgagacttcggtggatttagattctatttctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagcttgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcnggggagcatggctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccgcctgaccgatccttaaccggatctttccttcgggacaggcgagacaggtggtgcatggttgtcgtcagctcgtgtcgtgagatgttgggttaagtcccgcaacgagcgcaacccctatcctcagtagccagcatttaaggtgggcactctggggagactgccagggataacctggaggaaggcggggatgacgtcaaatcatcatgccccttatgatttgggctacacacgtgctacaatggcgtaaacaaagggaagcgagatcgtgagatggagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaa

SEQ ID NO: 5 - DNA, 3415035 bp, Blautia stercoris (residues 1-1,707,518 of 3,415,035)
  strain 830 chromosome
aactgtggattttttacgagtccagtgtaattcatcttcaaaagttgatactgcactttctgttaatgcaatggaacttgtgattgccgcaaacaatactaacaggaaaaataaaattccaaccgcagttccgaatcccatatttgcaaatacttttggaatggtaataaacatcagtgccggaccagcatttaaggtatctgcatttccaccggagaaagcaaatactgccggaataatcataagacctgccatgattgcaattgcagtatcaaaaatttctacattttgggttgattcctcaattgaagtatctttcttcatataagaaccaaacgttactaaaatacccatcgcaattgacaaagaataaaacatctgtcccattgcagacactactgtcatccaggaaaagttcttaaaattcggtactaagaaatattttacaccttcaattgctcctggtcttgtcacagaataaactgcaataataactgataatacaaccagaatcggcatcataaatttagatacccgctcaattccgttacgcacacctgcataaataattccaagtgtggcaagggtaaagattaagaaacagatttctgttgataatccatttgaaataaagctggaaaaataatcatcggaagccagattcttggactgtcctcctatatatcccaccagatatttaataacccatcctccgataacggaataatacggtacaatcagaatcggaataattgcattaatccatcctccaactgcaaatccctttgactttccaaagtgctcaaatgcaccaacgggactctttctggtcatacgtcctaaagaactctctgccataatcatggtatagccaaatgtcagtgccagtatgatgtagaccagtaaaaagattcctccgccatatttcgctgccagatatggaaatcgccaaatatttccaaggcctacagaagcaccggctgctgacaatacaaaaccgagttttccagagaaggtacttcttttcttgtttttgtccataaaaatattctccttcttttttgaatatacctcttagtgtaacataggcatggcaaaaaagcaatcataaggactggaggttttttgtcaatcaagtggatattcgcaatccgctttgctacttgctcataaccaaatagctgctacgcagcttatcagaagggacttgccccctcctgatacaagcaagtccccacccctgcttattgcttttcgcaattgaagcaggggacttacttgatttggttaaattaaaaacagagagaacctttcaaccggaactctctgtttttggctctctcatcatttaataaataaattcaggaaaccggtagactgtaagaacaaaatggtcataatcaccggcatgatgtaacaaatcataatgttatataatttttttcggccaaatttgccaccatttaattccatctcttccgcaatccacttcggtttcataatccatccgattaaaatagaagaaagcaacgaaataaacggcatcaggaaactgttactgatatagtccataatatctaataactgtccgatacttccattcggaagtttgacttccacataaaagatactgtatcccagagcaatgactgctgttgcaattaagtaaataacagataacacttttgttgtaatttttctttttgcatgaaataattccatacagttcgcagtaatagattccaatacagaaatacaggaagttaatgctgcaaatccggcaagcacgaaaaatacaattccaattaacctgccggcaaatcccatactgaagaatacttttggcagagaaacaaacatcagcccaggaccggcggacattccgtctaatccagagaatacatagacagccgggataatcataacacctgctaaaaatgcaacaccggtatccataatttcaatctgggatacggccttatttaaatcaacgtctttttttacataagaaccataagtaatcatgatacccatagatacacttaaagaaaagaataactgactcatggcatccagtgtaatctgtaagaaacgactcactgtaagcccggagaaatcaggagtcaaataaacttttaaaccatcaataccggttcttactgttccatcatccagtgtattcttcagagttaatgaaaagatggcaattccaattaccatgactaaaagaatcggcatgataaacttagaaactcgttcaattcctttttcgactccattataaacaataagagccgttaacagcataaagataacaccaaaccacacagaggatggcgaagaaataaaggaagtaaaacaattatcatctactgcctgttttcctgaactaaacaaataaatagtaatatattttaaaatccatccaccaataactgcataataagtcataatcaataccggaacaaggaaagtcaagattcctaaaaatttccattttttacgcattgactcataagcgtaaatcgcactttttccggtttttcgtccgattgcaatatctgtagtcagtaaagtaaaaccaaaagtcaaaaccaatacaagatagataatcagaaaaagtccccctccatctttcgcagccaggtaaggaaacctccataaattgccgactcccacggcacttccagcggcagcaaatacgaatcctatctgaccgctgaatccacttttttgtttcattctctttcacctcatcttttttatttaacatttagatatcatgccattaaaacaatccagacctcatcagtcagtgtgttgatttgctacgccaaacagcgtctgctactccttcaccggaattttcattggtacattttatcattaaacactctttattgtcaatttctttatttcaaaaaatcctgtacattatctttcgtcactttttcataaggcaaatagatatatctttgattttcaaattccacttttttcattttttctccggtaacaagctgacgtgcaagctgtgccattgcatttgcctgtgcctctttatcattatataccgtagcggccatcttttcttctaaaacagcttctaaaccttcatctgtgccatcaattcccaaaaaggccggaatatcagtctctgtatagccgagcttttcataggcatcaatcgctccaagtgccatatcgtcattatttgccagcacaagttcaatctgattgttatattgattgatcatctgtgtcattcgattttgagcctgtgcccgattccagtttgcgatttcataacttagtttttctaattcaactcctttttctttcaaactgtcaactgcgctctctgttcttacgattgcgtcctgatgtcccatttccccttccaatacaacatactgaatttttccgtctttatttcgatcaaccgtttttcgttcccaaatcaaatctgctgccagctctccctgcatgactccggactgctttgcttttgctccgacataatacagtttctcccactggttcaaatcctctgccacaggctcccggttaaagaaaatgatcggaatatcactttcctttgccgcctcgataatttcagacggattggttcgatctgccagattcacacaaagcacgttacatccctctttgattaaacgcttcacctgatcattctgtattttttgtgaaccggctgcatcctgaaccgttacagatattttatgttgatttgtttccagcctgttgcactcttctttaaaacaggacaccagttcattgatatacgtatcactttgattgtacgaagcaagcccaatatttattttttcggtttctgttttttccggcattccacaggcacttaagccacataagcataccaaaaacacgaacgccagttttttttgtttcattttttcttcagcctctctttgttttcttactgactcatcttaaataacaattcctgatttttttctgaaaataaattttcttttcgaagcacagtataagataatactttgccatgcacacaatacgtcattttttttaaagcgtgtgagagttctaccagactttcatatcccacattaaattcatccggtacaagcaaacactctgcttctccggtatccagataatatgctgcctctgtcgagcagccaattccataaatcatagaaccataaatttcattttcttttaccgcttttcctgcctctaccagacttcgatcatctaacgcaaacagataatctaccttttcctgctgttttaatagctttgcatcttctcccgcttctgtcacccaacagattttggcatctgtttctgacaaagcatcctgtactcctttttctcgctttttaattgcttcagaacgattattacttaaaaaaattccgactttcttctgctttaattttccatcgttatcctttaacaactcttctaccagacgttttcccatttcataatggtccggctctgctacaggaattttggaagtgttttcaggcgctgccgaaagttcagaaagcaataacaccggtacctttattttttttaactgttctgcaagcgtttcgtctgctaccggctcgataatcagtgcatctgctcctttatcaatttcatgttgaatagcagacatttcctcttttgcagtctgaaactgtgtcggatttataataaatacatccacattttcatcctgtgctgccatctttaatccatacttaaaagccgaccattgcgtttcatctgaattttgaatgattacggaaattctttttaaatcctgcccttgcctcttttgaactgtaaaaataatcattccgatcagcaaacatcctaaaatgcattccactaaaataaacatttttttgctacttttcataaatttattccctgtcttttttctgtatttgatccttgctgaataaataacctttttcaagaatccgacgattttcttctgtatatacgattgcaggaatacgaatcaaaactgttgttccttcatcaagttcactttcgatttttaagccatactcttttccaaataagatttgaattctgttatttacattcgtaagccctactcccgaacctttcttgtgaactcgattcgtatccatcaaaagaaattcaatttcttcttccggaatcccaattccattatcaatcacggataaaatcaacgttccctcttcttttgttacctgaaccttaatttctccgtcctcatcttcttccaacaagctcattccatagttaattgcattttcaagaattggctgcagcgttaatttcaccgcacaatattgttccaattcttcatctacttcaaaagcaacctgaaatttatttttataacgcactttctggatattcatataactttttgcatgctgcaattcatcttttaagctgataatcgtatgcccttttgaaagactgatgcggaatagttttgcaagctgtgagatcataaacgtcgcttcatcgtttcgctctccctcaatcatccaggtaatcgaatccaacgtattatataaaaaatgaggattaatctgactttgtaaggcatccagctcactttttcgcctttcattttgctcccatacaatttcattcatcaacatttcattgcgtttataagaattttggattgacttacctaaatgccggatttccagagaaccaccaatataaatatccggttcttttccggcctcatgctctgataccgaatgattcaattttaaaatcggacttgaaattcgaagtgaaacaattcgattgacaagcactaacatcattgccattaacagcatcaacatcacaataaaacattgcaaattcgtcaactgatctgtgaaaatcgaatacggtatcacaccaactaatttccagccggtataactgattggacttacgattacctttctatgttttccctcgaagtattcatcataaatcatcttttgtgattttgcggccgcttcgctgctttcactgagctttccgtcactaatctgcatctgtctcggatgataaatgattttgccattactatcacataaataaaaatactgcccattttctaaggtgttaatctgatccatcatacgtgagatttcagaataatccatatctaccaacaagacacctttttgtgaatttacaccatttgtcaactccacaacacgacttgaagaaataacccaataatagcgaaacgttccatcatcaaataaattctggatatgtggaatcgaaaaatgtatattttccatttcatccatcgcatggataaaccaatcctgctttgtcacatttggatcctctttttgagatacgaccggctctgctgcaatcagacttccaaaattattataaattgcgatacttcttaatctacttttatttgcttcatataataactgcattcctttttgaatttcttctgactccgtagaaaaatcgctttcttttatcacactataataagctgcatcggaaatttgtctcatattcatcagataatcttccatgctttctttgctttgttccatcagtttttgtgtgcttttaatcatttcctgcctggataagttagagaaacgcatatacattacaattcccgtaagcagcatgattgaaacagaaataatagaaaacgcaaccataatcgtcgactggattccgcctggttttaatctctctaaatagtttgcgattttatttctcaccttttgcatactccgttctatatttcgatggagaaactccatattgtcttttaaatacataactaaaataatttgcgtcggtatatcctacactttttgcaatcatgtaacttttttcgtttgtttctattaaacgtttacatgctttttccatacgatactctgtcagataacccacaaaagaatttccggtctcttttttaaacatgctcgaaaaatacgaatttgacactcctaattcttcacaaatatcatccaaagaaagcccttcttctctataatgactttctacataggtttttgcttttgtgatcaacgactttgtagaagacgaacgggcatctgtaatctgctcccgaaaagagaggctcacttttaacaaccatttttttagtccttccggttctaaattgattaaaatctgataaatctctcccatttctccggaaaactctttactgctaatttcattattttcagaaaaacgatacaaggtactgattagttccattaatgcaacatgatgtttttgtagtgtctcagatggcacaaacaaatgttttaaataattttccacgctttcttctatttgtgcttcggagccaaggcgaatcattttaaatagttctaaaagttctccctcgcttgacacttcctggtcgacctgttttttcgggacaatttccttaatattaattgctctggaacttccatataatactctgtaggaaaccgcctcttttgccccttgataagattttgataattccagcagttcgttacaaactgccccaactccgatggtggtaacggcgccaagaattctatgcacatatttacaaaagcggtcacattcgtctgtcaattccgaaatctcactttcctgtctaagctgtacaattaaaacagtatttcctaaataagcaaagcatttcgctttccattttggtgctaattgctcttttgcctgcctttcaactgaaattgctaacaattgcggattcattccttccggcacccgattggtcgatgtatgaatcacgatgcagccaaacacaggcgcttcaaattgaatttgataatcttttaaatattgttctaactgttcttcataaatgcgtccttcaattaaagtcgaataaaagtttgcctgaagcagcggtaaggaatccatataatacttttgcagcgtttctacatttcgtttttcgtcgatttcctgatccaatttctgttttaattttgcaaatacttctgttagttcaatcgcatttaacggttttaagatatattcttcgatctccaagtgaacggcttcttttgcatattcaaattcatcaaagccggtaaataacaaaatttttgttgtcggatatcggcttttgatttcgccacaaagctgcatcccgtccatataaggcattcgaatatctgtcattactacatccggttggaattcctctatcatctcaagcgcctttaaaccattattcgcatgaccaattacgcaaaatccaagcttgtcccaatctatttttctttcaatcacttgtgttacttcttcttcatcatccaccaaaagcaagctatatgtattcatccgcttttctccatttttttaattttctttttattatacatgattttatgcaaaaaaagaatcctgcatttttttgcaggactcttccttttgtcttgattttttattattttttctgtacgtattttaagcagtccagtgttaccgctacaagaataatgatacctgagaatacgaactgaaggtttgtatcaataccaagaatagtaagagaataggtcagtgctgtaaagataaatacaccggttacaacgcctgaaattttaccaataccaccggtaaaggatacaccacctacaacacaggctgcgatggcatccatttcccatccctgtccatatgctgcggaaccggaaccaaccattcttgcacattccagccaggcaccaaatccataaagaatacctgccatgatgaatgcaccaagcataactccaaatactgagataccagaaactgctgcggcttccggatttccacctactgcgaaaagattttttccaaatgtggttttattccagataaaccatacaattgcaactgctgcaacagcccaaagaataatagttgggaaaccatttacttttggaatgatcattcccggaatagatgcctcaatcgcaccaaaggatacaccttttgttgaataagtaactaaaccaaagattacaagcatatttgccatcgttgagatgaacggatgcatttgaaatttcgctgtaaaaaagcctgcaattgtagtaaacaaagtacataagaatacacacacaactaatgcaaggaatactctgcctccaacagacattccggtaaagtcaaacacatgtccaaatactgtaccggtatttataccctgatgcatgataatggttgctgcagtcatacccataccaaccatacgtccgattgacaagtctgtaccggtaagcaagatcaaacctgcaacaccaagtgctaagaacattctaggagatgcctgctgtaaaatgtttaacacattgttataagttaacagtggagtaccttttttaatcggagtaataatacacagtgcaacgaatactaagataattgcaatatacaatccattctgtaagaagaaagaacgggtattaaatttgtatttgtagttttcccatttctgctctctggtctctaagaaagtaaattttgacaaacgaagcatatcaattaaatgatatttataactaaatgcttcatgtttttcgtctttaattgcctgatactctttctgcaactctaattttgcattggataaacggttcttataaacgtaattttcatctttaatttctttttgctcttttaatccggaaagaatttctttatgctgtctctctaactctgcaactctttctttatagtgttcctgagcctgtactttttccgctgcacaactttcttttaccggtgtgtaatactctttatcaaaatgagcttttaaataattttctgcatctgcaattaattttgaaatttcatctttatttttattttcaactgcttttgctttttcaagttcaacctgatactgtgaaattcggttttcacgttctccttttgtaagagtacgatcccttttgattccatcaataacattttggtactctaatacctttgcagtaccatcttttctaagtacatcaatttgtttttgaattttaccaacatattcgtcaattggctgacgaagtttcatcttatcttctgatgtaagaattttactatttgccatatctatcaatctccctttattttacagatacttcgcactcagtctcaaaagttcttcctgattcgtctcttttgtatttacaattccagaaagacgtccatttgacattacgccgattctgtttgtaattccaagaatctcaggcatttctgaagaaactacaataactgtttttccttgttttgccatgttaataatcagctcataaatctcatattttgcaccaacatcaattcctcgtgtcggctcatccatcataaatacttttggatctctctccaaccattttccgaagatgactttctgctggtttccaccggaaagacttgaaatcatatcatccggtcccatacacttggtatgcatagtcttgatttcttttgatgttgctctgaccatttttggatcagaaagtgcaactccgtttttatatgcatttaagttggcaatggttgtattaaatgtaaggtctccttttaaaaacagaccatttgctttacgttcctctgtaatcatagcgaaaccatgctccattgcttcttttgcactattgaaattcatcaactgatggtttaaatagacacgccctgctgctcttgtccttacaccaaaaattgtttctaatagttccgtacgtcctgcccccacaagtccgtacaacccaaagatttctccttctcttacatcaaatgtaatatcatcaagatgtggctcaaacttcgttgacaaatgctgaatcgataacacaacatcttttggaacattgtctaccggtgggaaacgattttccagtacacgtcctaccattgaagcaatcaactcattcatgtttgtctcttttgaactctttgtcataaccagatttccatctcgaagtactgagatctcatcacagatttcaaaaatctcatccatcttatgcgaaatgtaaatcaaagaaatcccctgtgattttaacattcgcatcatttcaaataatttattaacttcttgtaccatcaaggatgaagttggttcatccagtacgattactttcgcattataagaaattgcttttgcaatttcacacatctgtcgctcagataccgacatatttttcattggctgatctaagttaacagtcattccaagctttctgaaaagttcagatgcttctcttttcattcggctttcatcgatcattcccattgaattgaccggatagcggccaaggaataaattatctaccacatttctttccaaacactggttcaattcctgatgaaccatcgcaattccattttcaagagcatctttcggtccggaaaagcttacttcttttccatcgagaaaaatacttccctcgtctttctgatatgtaccaaaaagacatttcatcattgttgacttaccggcaccattttctcccataagacccattacggttcctcgtttcacatcaagattgatgtgatccagcactcgatttcggccaaaggatttactcattccacgaatcgataagacattttcttctctcttatctgtcatattctcactcctgtaaacattcgttagcgaaattttagggggaagtactcccccctaaaacttacttgttttcattccttttttttacatttaaattactgatttaaaattgcagtataggaagctgcgttatctgttttaaccatgttgattgcaaatgcatcatactggcttggatttcctaaacggtttgtgatattagattctgtctgtccatcacctgcaatatattcgatatccagatttaagagatcatcatatttctgaagcagtggctgataagtagaacctaagaagttatcaccagagttatagatgtttaaccatacttttttagatggatgtgcagattcatctaactgtttagatactggttcccaaacaactgtagaatctgtaaagtctgtgtagttgtctgctgtaaccgctacgtttaatgcatagtaagaacgttcgtcttctttgtatgtatatacatcatcacttaatacgtttcctgcatcatctgcggttccgatacctgtatcaatatcaacaccgtctaatgagttacgcagtacacgaagtgttaaataagcctgtacgtctgcatgctggctgattgttccgccgtatccttctccgattgcagcaactgcatcgctgtttgcatcatatccgaatgtaggaactttgttatcttttgaccatgcattgaacatagacattcccataccatcgttgtttgaaacaacaacatcgatgtctttaccaaaagaagaagaccatgtaccgattgcattacctgctgttgcagcatcccaggttgcacctgcggagtttttcatttcctgagaagctaactcacgtacaacatattcttttccgtttacttcaatttttccatcctgtactgctgttgcggtaccatcggtatttgttccaaccggagcactatctacttcaccatctttttcaactgcggttccaagagctttacgcacacctcttgtacgtgcgattgagtcattatgtccgatatctccgactgccaaaacataaccgattactccatctccgttacggtcgattttgtcaatatttttctcaatatattcttttaccattgttccctgaagttctgcaccctgatttgcatcaaaacctacataataagtatctttgttgaagtttaatgcagttgtatcaagttcacccgttgaactgttagatggctgacggttgaaccatactaaaggtttatctttgtttgctacatctgagcttgcctcagcgccggattctgtttttgcatcatctttctttgcactgtcaccagagtctcctgaaccacatgctacagttgaaagcgcaagtacgcttgccattgccattaacgctaattttctcttcataattttttctccttttcatttttgctcaagtgttttgtttatgttgacagtatatcgtttttaccataaataaactatagaatatttttgggtcttcattaaaatttttaggataatcttcgttattttgaccatttttcatcttatgctgacgcagtttcttacaaaaaaatatcgccagccacaattatgactgacgatatataaattcatttttatttttttgttataatcttgctacccctgtttttctggctgcttctgctactgcttttgctactgccggaccaactcgtttatcaaatgcttttggaataatataatccggatttaattcgtcatcggtaattaaaccagctaatgcatttgcggcagcaattttcatttcatcattaatgtctttcgctcttacatcaaatgctcctctaaagattcccggaaatgcaagtacattattaatctggttcgggaagtcacttcgtccagttgcaacaacctttgcaccgccttctttggcttcatccggatagatttccggtaccggatttgcacaagcaaaaatgactgcatctttagccatgctctctaccatttcttttgtcaccatcttcggcgctgatactccgataaatacatccgcaccctctaaagtttccgcaagagaacccgcttttttctccagatttgtaattttgctcatttcatttttgactggattcatgccatctgctctaccttcatagattgcaccatggcggtcgcataaagtaatatttttatatcccgcttttaataataattttgcaatcgaaattgctgctgcgcctgcaccattcattacaatttttacctgtgatttttcttttttcacaagcttcattgcattatttaaaccagccagtgtaatcactgctgttccgtgctgatcatcatggaagatcgggatatcacatttttcttttaattttctttcgatttcaaaacatcttggagccgagatatcttccaggttgactccgccaaatgaaccggaaatcatatagatggtattaacaatttcatccacgtcttttgatttaatgcaaagaggaaatgcatcgacatcaccaaacgctttgaataatacgcattttccctccataaccggcattccggcttccggtccaatatctcctaaacctaatacagccgaaccatctgtaacaactagacacatattccatcttcttgtcagttcataagatttttcaatatctttttgaatttccagacatggctgagcaactcccggtgtgtaagctaatgacaaatcatcttttgtttcaaccggaacatttgctacaacctgaatttttcctttccactctttgtgtaatcttaatgattcttttgcataatccattttcgtttttctctctttctctaattatttttaataatttccttcaaagaatctactgtctttttgtaactgataacccttaaaataactattaaaatccaattttaagtattcacagagatttgcaagttctgccattgtattatcgttgacctgaattccattttccagacggtctttttttgccagcacttctttttctccgtgtgtataaattcgttctgctccatctgcttttggactttctcttaatgcttctaggtattcagaaaaatgtttcttaatctcctccggatttccaaaaattgccgggttcactgcaataaatccatggcagatacctgttttatctttaaaagtgcaacatttatcagaagtgacaccctgtgataaaatagaactaaataattcacataacattccgtatccgtatcctttgtggcttccatttacttctttatttccaccaagcggcatgattcctccgcctcgttttgctacaatatttgagagtacatccggtgcatctgtgctttcttttccgtctttatcaagtgcccagccttccggaagtggtttttccattttattatacatttccagttttccacgggtcacaaccgttgtagaacaatcaaataaaaacggatacggttctgccggcattgccactgcaatcggattggaaccaagcattgctttcttaccaaatgtcggaaccataattgcctctgaattcgtgcatgccataccaagaagtccttcatcactcgccatctttgcataataaccggcaattccaaaatgattggaatttcttacactaaccattccgattccggatgtttttgctttttcaattgcttttttcattgcataaatggaaatcagctgccccattccattatgcccgtcaatcacagctgaaaccggtgtctcaaatacaacttccggtttcgcaagaggatgaatggttcctttttcgattcctttatgataacgtaccatcctctgcataccgtgactctcgattccaaataaatcagcggtcaaaagcacatcctctatctctttgctctgtgtttcatcaaatccaaatgcacgaaacacatcatggcaaaaatgttccagtactgaataactccattttacatatcccattgttgctcctcctttggtattccgtattatatattggtattgccaatttttaaatgaagtataccaccattcttttcttttttcaaccttttttccataaaaaaagaagaaaacttttttaaaagctttccccttttttctttcgatattctcattgattctcctgcatcatttctgcacgttcttcaatatatttttctatatttatcatatgttcctgcatataacgcactgctgattcttcatcatgtgcaataattgcgtctaccagtctcttatgctgttcatcaatttctgtaaccgacatttgtttctgcataatataagcacgaattcctgtaataatattttctgtcagctgggaagctgcactcattacattaaataacattggattatttgccatttttccgatctttatatgtaaatctctgtccaaatctcctcttatctgttcatcttgttctacctcaagttttgctaaaatcaattttaattccgccgcatcaatcggagaacaatttctggcagccaattttgcacattggatttcaagtgcggaacgaagctgctgattttgctgaacactgctgttatttaactgtaataaaatcgaaagcggaccaatcatacaattttccaaatcttctgaaatataattcgcccctccatgaaccgtttttataattccaagaagacttaaagaccgaagcacttctcttataaccggtcttgaaacccccattgcttctgccattgcacgttctgccgggagcgcatctcctttttttaatctgcctgctctgatattttcgataatctgatttaaaatttcatcaaacgcattttctttactaatctgcctgaacatatttctttccttcctaaaaaataatgcttttctttttcatcctttttttattatacgtcttttcattttaagtaacaagctgaattttatagcaaaaagaaaagcctacgaagaaaatttctcccctacttttgtttgattcaaaggtaggggactcctcctgatacaagcaaatccccacccactgcttattgcttttcgcaattgaagcaggggacttacttgattcggttaaataattgctttatgttttcttctgattacttcaagaatcacaagtgtaacaatgacaccaaatgccagtgatatccatgcattttgtgtgaatcctgctaccacataggttacacagctgattgccgcaacggtaagagcatatggcagctgagtagaaacatgattcacatggtcacactgtgccccggcagatgccataattgttgtatctgaaatcggagagcaatggtctccacaaactgctcctgccatacatgctgaaatggaaataatcataagctgtggatttgaattctcaaatacatgtacaacaatcggaatcagaattccaaaagtaccccaggatgttcctgtcgcaaaggcaagtcctgctcctactaaaaagatgattgccggtaaaaatttcataaaacttccggcacagccctgcatcacagtatccacaaactccgctgcaccaagactgtctgtcattgcttttaaagtccaggcaaatgataaaatcataattgccggtaccatcgctttaaatccttccggaatacatcccatacattcacggaatggaagaattcgacgtgccacataaaagataatagtaattaaaataccaaacatacttccgattaccagcccgacagaagcatcactctgtgaaaaggcagttacaaaatccacgccggagaaaaatccgcctgtataaatcatacccaatacacagcagacaacaagacttaagattggaaataccaaatctattacttttcctctctgtgttacggtctcattttccgctgttgcataaggacgagctgatgtagtataaatatcaccattgattgcattgtgctcatgtgttctcattgaaccaaattcagcttttaataaaaccattccaaccatcataaccagcgttaacaatgcataaaaattatacggaatcgcttttacaaaaatcgtaagtccatcttcgccctcaacaaacccactgactgccgctgcccaggatgaaatcggagcaataatgcagaccggagctgcagttgcatcaatcaaatatgctaattttgcacgtgaaatattttgtttatctgttaccggacgcataacacttcctacagtaagacagttaaaataatcatcgataaaaataagaacaccaagtaaaatggttacaagctgtgttccgatacgactcttgatttttctgccggcccatctgccaaaagcagcagaacctcctgctttattcatcagacatacaaccgcacctaaaataacaagaaagattaagattcccacattataagaatccgatataacagaaataaatccttcctgaatcatatggacaacggttccttcaaaactaaagttcgaataaaacaatgctcccactaaaattccaataaataaggaactgtacacttcttttgtaatcaatgctaacacaatcgctacaatcggaggcaccagtgcccaaaaagtagcatacattttcggcacgtattctgctgcctctccatctgcggcaaaaactgtcaccgcacagaaaaaggtcagcatgagaactgccatccctcctgtaagcagtttttttcttacgcttttcataaattttcctctctttcttttggaatgtactccataagagtacatttgatttctttatttaccggactttgtaacatccaagtcgaagattaaaacaaaagaaaaaccatgaacggtttttcttcgcaaagaacccattcatggtttttattcaaaataaccctgagatagctctccacattcgtgacagtataatgcatcttatccattatcccagagattgtatttttgagtgcaaatccatcccttcggcagtctcccctttcttgtttacctgtcactcaccatctggtaaaaaatactcttgaagcccgcacctctatcttttcctctttttatctttttatccggcttatgccagaaatctttttctttaacaattatactataccatcttacaaagcaaaatccaatacttttcgacaaaaacttttcgatatgcgttttacacaaattatattgtataaattccaaaattatgttaaaatagtataaacaaaattcggattcattctatattttttatgtattctgaaaaatttttgagatattgtatatgcatttaaggaggggtttttatgtcaaaacaggtaattacaattaaccgtacttatggcagtaatggacgtctgattggaaaagcactttcagaacgtctaaacattcctttttatgacaaagaattaatcgaactggtcagtcaggaatgtaatattccggcaaaagaattagaaaaagtagatgaaaaacgcgcaaatcaatggcatcttcctctaaaagaagcaatgcagatggaaccacagtatcattttcgtcctatgaacgacgtattgtttgatgcacaatcgactgttatccgtgaccttgctgaaaaggaagactgtatcattgttggacgctgtgcagattacgtgcttcaggaaaagaaaaactgccaccgggtctttatctatgctccatttgactaccgagttcaaactgtaatccatcggctcgaccgcaacgaaaccagcgccaaacgacttgtcaaaaaaatggataaagaacgccgttattactatgaatattttacagaccgcaagtggatggatatgaaccattatgatttatgcatcgacagcagtaaattttcagaaacagccatcttagatatcttagagactttgtatctaaaataattaatctccgtgagctaataaccgaacttcttaacttaaaagggagtgtcagactggcactccctaaaagcatcatcattatttatttttaattttagttattttatttttgtaaagcatccttaaatttttaccactctaagagcactgctccccaggtaagccctgcaccaaatccggaaagcaccagtttatctcctcgatttagcatcccatttcggttcatttcatcaagcagaatcggaatacttgctgcagatgtatttccatacaaggataaattcattggaaacttctcttccggctcttttaaacgttttgcaacagactgaataattctgctgtttgcctgatgcagaatataataacggatttcttctttttttacttctgcttttttcagaacttcttccacacactccggcaccgtctttactgcaaatttaaaaaccggttgcccttccatatacaggtactcttttgtttctgattcatgattcagcaaatttctggtttctcttgccttacagcttaaaactccttttcctgccccatttgatttctgaaccagttctaacacccctgtctcttcagcactgacaaccgctgctcctgctccatccccaaataacacacaggtacttctatcactccagtctatcatttttgacatcgtttctgctccgacaatcaacgctttttgatagattccaccttttatatacgcctgcgcagtacttaaagcaaataaaaaccctgagcaggctgcacttaaatcaaatgccacagcatgctttgcaccgattgcctcctgtacctgacacgctgtattcgggaaaaaataatccggtgtacacgttgccacaataataacttcaatttcttccgcagtgacacctgcattttctaatgctctttttcctgctaaaattgcaagactcgttgtgttttcttcttttgcaacccttctctctttgattcctgaacgactgctaatccattcgtcactggtttctactatcttagataaatcttcatttgttacaatctgctctggaactgcacttcctgttcctataattctggctgtcattttatttacctctattttcaaatattttgataatcaaacaatatatagcaagtatacaaagaaagagattatttgtcaacacaaacaacctcttctcttacgcagtcttattcactttttttatttcttctctcttggttcataaattttcctgatttcctgtgagagttcacgatttaaatcatctaaatctacaactgagtgaggctcataattggaataactgtttttctgttcctgctcttttggctcgtcctctctctgattccggattcttctataagaagaatcctcttccttggaaattcctttccggtttggatttccttttttcttattcgtagtcttattatcctgctttgttactactttattgttagtctgataaaccgtttttttcttttttttctttcttgatggcagggatggaagtgtcggaagtgaaaaacttcttgggcttctttttcttctatctgaaaatctgtctgacgaaaaacctctttctcgactttgtttgcgcagataaggtcctgcctgtattacaataccaaatattccaagaatcagtcctaaaagccagaccgctgcattttcctgcattttagaaagttcaaacaggcattttactgctccaattccgccacacagaccagtaattacaatcactacatgtctctcatatcctaatgccatcgtcgctactacaattccgactgccagacagataatccggcttgtcacatcttctcctgaaataaaggaagaagccaaccagtaaatcaatccggtacaaagaataaaaatacctgctttataaaagcaccaggctatcatcccaagaaacagcgcaaccaatgctccggcaattaaaatataactctgttttcctccaagataataccatgctgccgcacctccggctactgctccgattgccagtcctaaaagagttccccatacttttctaagccgatatcccataaaacagtttagcagtgcaaatatcattcctgccagtaaaatccccgtcatatatttctgtgttatattcccatattctgaaactaccatgtttaatatctgtgttatattcatctctttctaccacctctcgcacctacctaccttaacacacatattttaacttcttaagttcattaatgtgaattttttatttcttttcctttaagatatgaattacgaatgtaacataatgtttctttttcacctttttctgccaacattcgtaataaaaattccaaatcacggtttgtatcctcatgcacaaaccacaatttacccttgcttttcaaaaaatattctaaaggcgcacggttcgtataagattccggatgatacacttttgaagcacaaatcctgtccatcaccatctccgctatataattcctcggcatcggcactccttttataatggtatcacaatcaatcccataatctacccaatgttcaaaatgatgtttatttcttccatagtgatgaatccacgctgttgaaagccctgttgcttctctctccgcattgtttggactgcggtttccctgataatatttacatcctgctgaaaattctgtccatgaatactttgacaaatcatggagcattccctgccgatatagtcctattttaaagcaatatttcataaccatcagtttatgttttgtaattgttttaaaatgtccccagatatgcattaattctcatcctgctttccttttaaaattactacggttcttggtccaacctttattgttactttcttcttttgaatttcttttttctttttatttttttctgtcttttcttcttttaaaatttccgtttcaatctctgcgtcttcaccacttgtcagaatctgttcccatgacattttttctgaaagacttggcagtccaaattcatgttcattccagtgaaaattataggctgcaaagagcagctctttttcacatccggcataatcttcacagtatagaattcctatgtgacggtactgcggacttccggaataataccacggctgattactatgataagaaatatccggatatcccacagctttataatctgccccttttaattcgctttccagatgcaaaatcgaatgcatttttcgaatggaaaccgcttcttttacaaattcaaacagttctttattctgacgcagttttttccagttcacccatcctgtttcattatcctgacaccatgcattattgtttccgccctgtgagtttccaaactcatcaccctgaaaaataagcggtgttccctgacttaacaacaacataagaaaagcgtttttcaactgtcccatgcgaagccggcgaatacttttttttctgctgtacccttctgccccacagttccaactgcagttatactcaattccatccctgccattttctccatttgcctcattatgacgttcatcataagagaccatatccatcattgtaagaccgtcctggtctgccatataattaatcacaccactgtttttgtaatttcttttatttcgataaagaaattcttctatcattccctcatcactttttaaaagatgacgcatacaatataaaaatccatcattgtactctgcaatatgccgaaaagacggaatctgtttttgataaatctgctctgcattaatatcagaaaaaaataatttactctgtgaaagccatttatcttttaccaaaacttccggcaatacgccctttcccatcagatgaaatccatcaatatgatacgttttcatccaataatgcagaatatcaagtatctgtgaagaaccgacacttccatcaaaataaaactccatcaggcactcaattcctgcaccatgaagcgaatccaccatcttacaaaattcctgatatggataatcggtactgcaaaaagaggcctttggtgcaaaataatttgcttctccggtatagccccagcaatttacccgtacctgtttttttctttctccaaagcgttctggttcttttacttcttttgaacattcccgatactcgtaagccggcatgaaaagcacacctgtaattcccagcttttttaaataagcgattttctgctctactccacgaaatgttcctttctcccttactccggaatccttatcttttgtaaaaaaacgaacctgtaatttatataaaatactgtctgagagtaaaatcggagaaaatttttcttttttccagtgataattttctttttgataccgacatcttactgcatgttcttcttttggatattcttttccaaattcactcactccgctcaaagaatgtgcataaaaatcctgctgcacttccccatccacacagtagttatactcatactcatccatcgaaattccggatatcataactgcccgatagtcgccaaaacttttttcttttgaaagtggaaccgctatctctggtctgctttccccttttttataaaaaagcagacttacttctttctctgcttctatacatgctgtaaacacatatccttttcttgtttttacgacacccggactttccggataaacaactctccactgcagtttattttccgtctcactcacacattctctggacaagcttttcacctcatttcaatttttcctgttccttacacagcacttccattctgtcatgtacactcgaagcatcagactcatcagtcattgtgacaatcgtatccccattcataagaatcgtatgtccctttggaatgagttcacttccacttcttttaattgctactaacagacagttttttggccattctacctgctgtatcattttattttgaatttcacatccataacttacaatatattcctgtaaaaccttttctccggtctttttcgaaactttgattcctcgtttctttaacaaattggtaagcagactttcataaatcggttcggatttaaatgccgtagccaccagataagcgacaattgaaaccaaggataacgacagcatctggctgaaacttcctgtcatttcaaaaatcagaatgattccggtaatcggtgctcgtacaattgctgtaaaataaccagccattgccagtacaataaaattgctgatatactgtgaatccatcccaagatatgtgactgcaaaagaggcataagcgcctccaattaaagaacctaatactaaaagcggaaagaaaattccgccaggtgctcccgaaccaaaagaaacgcatgagaaaaataacttcatcacaaacagaaacaggattccctttaacatcatattgccttcggcgaccatatcaaccagattatgtccgcttccaagaatttccggcattgtaaatccaaaaaatcctgccatcaaaaacggaattaacagtcttatcgtctctgatcgttttccttttatttttccaaacaattcctgactctttaacgttactttattataaaaagcacccataatacctaaaataattcccagtgctatgatatgtccataatatgaatcaggaattgctcctgtcacctcaaactgaaaaaccggacgaaatcccataaattccgccgaaatataatctgcggtaatcgacgctgtcataacggaaatcaagaccgacaccgaaaagtttttatgtatctcttctaatgaaaacatcacacctgcaagcggtgcatgaaatgctgcggcaagtccggcacttgctccacaggtaatcaaatatttttcttctgtttttcctcttccaagcaggctcgaaaccgcttttcctgacattgctccaatctgaatcgacgggccctctcttcccaaagaaagacctgcaaacaaagataaaaaacctccaagaaattttgctggcagaaccctccaccagacctgatttaattttcctgccatttcaccttctacctgtgggattccacttcccgaaataaaaggttccttttttaccagccatccaacaatacatgccagcgtaaataagataaaaaaccagactcctgctgcaaatggatactctcttcctaacgcaagcacaaaattcatgacttttcccgcatattccaaaaggacacgatacgcaagtacaatcaatcctgctacaactccaactaaaaagccttctactgtcaagattgatttaaaatgtgcagccctttttatcaaatgagacgtatcttctttcactttctcttctcctctctcatccgtaaatgtgctcttaaaatctttccagaaacattaagagtacatttagagtaatacttttattatacgtgcccatagtaaaaattgcaattgccaattgtcaatgcttgaaatctttcaagtcatctggtactattaatataacactataagtattaagaaagaggtaattaccaatgagtgaagaaacttttacaaccaatatcggaggatgtgacccaagtgactgtgcgtcctgtacttcagactgtgccggagccggacaggcaattccacgcgttccaaatcctaccattaagctgaccttagaagacgattccgttttagaatgtgccgtactgactacttttgatgtagaaggatttggcgaatacattgcactgattccattagataaaaacggcaaaaataagagtggagaaactttccttttccgttatcatgaagaagacggaaatcctgttatcaataacattgaacgtgaagatgaatacatggctgctgctgaaagcttccaaaactttatcgaaaatcttcctcacgaaaatgaaatagacgaagagctggaggaagaaccagacggaaaacaaagtgaagaacaggatgaagatatttttgccgaataaaaacactataatatgcagtctcatcaaaccccaaaagtttccgagactacattcattttaaagggagggaatactttggaacaattacaaatctgggacagtcatgttcatttatttccaccggaaatttataataactgggaaacttatgctgcccgcgactcgtggtttggcgttctgaccaaaaagccggaaaaccacaaaggaaccgaagaagcctgggccaatgccgaagaagcgcttgactgtgccacacaagccgggattcatggtttagtcatgcagggatggtactggaacgatgcgggactgatgcgtatgcataatgactatatggcagaaagcatgaaaaatcatccagaacgcttaaaaggattcatctcaattaatccaaaattcaaaaaagaagccattgcagaaatcgaacgctgtgccaaactcggcttctcaggaatcggagaacttggtcccggcggaaacggctatgattttaatgactctgattttatcgaagtcgtagaatgcgcaaatgcctatcatctgccaatcaatatccactgcggagagccggtcggtcatccttatccgggaaaagacatgacctcccttgcgccgcttcctggcttaattttaaaatatccagatgttacatttattttagctcacatgggtggtggacttcctttttatgaattaaatccacgttatcatggaaagttcaaaaatgtctattacgatacagccgcaaatccactgctttatcacatcagcagttttcgtgctgttattggtttgattggaagcaaacgactgctttacggaagtgattttccactgcttttatatccgtctaaaaacagagaaatggatttttccatgttcgtcaaccaaataagaaacgatgcctgcctttccaaagaagaatggaatgatgtgatgggtaataatttacgacgcgttttagatatttaaacaaaactatattgaatccgaaaaggaacgcatgctgcattttaactgacaacatgcgttccttttcttatcttattttttttatttttctaaactcggaattgcaacttctaagtctacatcctttgcatagtccacaccatcaagatgaaatccaaacatctgataaaaatcctgccaatatccatcaatatctgaaagttctgctacattttctgttgtaacgttcttccagcactccattactttatcctgaacttcatcggaaagctcccagtcatccatacggattcttccctgttcatctgttaccggtttttctacaaataatttttcatgaaacaatcttgaaatctgttcaatgcatccctcatgcgttccctgtactttcatcactttatagagaattgcaaaatacagcggtacaatcggaattgctgcactcgcttgtgttaccagtgctttattgacagaaatataagccttaatatctgaatatttctcattgattttttctgctgtctttgtcagatgacgttttgcctgaccaattgttccatcataataaattggataagtcagtttcggtccaatataagagtaagctactgttacggcattttcagaaagcacacctgcgccgtgaagtgtgtccatccaatccatccagtcttctccgcccattactttaattgtaccttctaattccccatctttcgcaggttctacggtctttgtcacaattgtattatttcttaaatccagacttttttctgtaaatgcttcgccggtcgtctttaaggaagaagcccataccgttccatctgcagttgttcttctaggtgctgccagactgtagattaccatatcaacctgtcctaaatcttctttaatcatttcaacgactttttcttttacttctaaagaaaacgcatctccatttattgattttgcataaagtccatttttttcggcttctttttcaaatgcaacggtattataccatcccggagttgccgtacgttttccatttgatggcttttcaaacatgactccaattgtggaagcctgacatgcaaatgcagctgtaatacggcttgcaagaccatatccggtcgatgctccaattactaatactctctttggtccttctatcgttcctttatcttttacataagcaatctgtcgttttacgttctcataacatcctgtcggatgtgcggttgtacaaataaactctcttacctttggctctacaatcatcttattttcctccgccattttccttttcttctcaaatagtttgattctcaaagtatattatcataaaaaaaaaggaaatgcaaggtttgttttttacttctttcactacccaagcataatttccttttttcttaacttgttacaatttattactgctatttactgtcgcatttatttgttgtacttccaaatccaccatttctgatttccactacatcatcatccactgtgattccatattccacgaaaatgccctgtgcaaatccagttccggcttccacattgattactttgccttcgttggaatcatttgtaattttaataaacatatgaccctcattatccgaataaaaataatcgctgtcaataattcctaccgtattatttaactgtaaacgatatttaaatcccagaccgcttctcgggtaaacttttaaaacccagccttcttccatctgtacacggattccggttggaatcttaatcgtctcctgtggttttaactcaaaagtaagcgggctgaagaaatcatatccggcgcttcctgaagtcgcacgctttgggagcttaacagattcatagatacgttctaattcttcaccggaaatctcaccaaaggtatcctgccatccctccgcaaactgttctttactgactttcataaattttgcaattcgtttcataacgatttatccctccgcatgcagaataatctgcttttctttcaatgatttttgtacatcaatcactctctgattagaacttcctttccatttgagtgccacatttttcttctctatcataaattctccgtctaccagtacatccagataatttaagatttcttcgccttgcaaagactcccataatgcacctgtatacaaccagattgtcttggacggatacttttctttgatttcttttgcaagttttgttacctcagatatattttgtacataaagcggatctccaccggaaaatgtaattccggaaatataggctttttccagttgttcaaaaatctcctgcttcgcagactcatcaaataaaattccactgttcggatcccaggtcacaggattctgacactctttgcaacaatgagaacatccggatacccataaaactacccgaagtccgtctccatttaacatatcatcttttgtgatattatgataacgcatttttctgcctcccgtaaatttaatgtactttcggaatctttctgtgcttgattttgtgagaagattttttgtcaggtatgcccaaatttttgaagcgtacgtttaaaaagggagaaccgcttatcgccatgttctccctctctatgttacttagtcctgacttaaatttcttatgcttcttccggaacgtccttaatactgaagctgattcgtcccatcttatcttttccaagacagattactttcacttcatcacccagagtcagcacatcttctacacggttaattctttcttttgcaatttttgaaatatgaaccatgccctcttttccaggggcaaattcaacaaatgcaccaaagtcttttatgctcaccactttaccggtgaaaatctgaccttctttaaaatcagttgtaataattttgatgtaattgagtgctttatccatcatttctttttctgtgccgcatacagaaactgcacctgtctcatcaatatcaatttttacacctgtttcatcaataattgcattgattgtttttccacgctgtccgactacatcaccgattttatccgggtcaatctgaatctgaacaattttcggtgcatatttgcttacttcttctctcggctttgcaatacatttttccattacttctgtcagaatgtattctcttgcttcttttgtttttgcgattgcttcttcaataatcggtcttgtcagtccatgaattttaatatccatctgaattgcagtgataccatcatgagtacctgctaccttaaagtccatatctccaaagaaatcttccagaccctgaatatctgttaaaacaatataatcatcgtctgtttcaccggttaccaaaccacaggaaatacctgctaccggtttcttaatcggcacacctgctgacatcaaagacatcgtagatgcacagatacttgcctgtgaagtagaaccatttgactcaaatgtttcagatacagtacgaattgcataagggaactcttccggtgccggaagaaccggaactaaggctctttctgctaatgctccatgaccgatttctcgacgtcccggacctcttgacggttttgtttcacctacagagtaggacgggaagttataatgatgcatgtaacgtttggatgtctcaaattcatccagtccatccagtctctgtgcttcagaaagcggagccagtgtcgtaatcgtacaaatctgtgtctgtccacgtgtaaacattgcagaaccatgtactctcggaactaaatctgtttctgctgccagtggacgaatctgtgtgattgcacgaccgtctggacgtttatggtcttttaaaatcatcttacgaaccgtttttttctgatactgataaacagcttcagaaagtacagccagccattcttcattttctgcaaatgcttcttctaatttttctgtgataacacggatattttcttctcttgtctgtttgtcatcagagaatacagcctcttccatttctgcaggaggtacaatctctttgattgctgtaaacagttcttccggaacagcgcagctttcataagcatgcttttcttttccacattcagcaacgattgtatcaataaaagcaatgatttcctggtttacctcatgtgctttaaagattgcatcaatcatttttgcttccggaacttcatttgctcccgcttcaatcatgattactttgtctcttgtggaggcaaccgttaactgtaaatcagaaattgttttctgagccagtgtcgggtttacaataaattccccgttaatcataccaatctgtgtcgccgcacatggaccatcaaacggaatatcagatacacatgtcgcaatagaagagcctaacatcgcaacaacttccggattacattccgggtctactgacataaccatgttatttaatgttacatcatttctataatcttttgggaacaatggacgcattggacggtcaataacacgagaagttaaaatcgcatgctcacttgctttcccttctctcttattgaatcctcccgggatttttccaactgcatataatttttcttcatattctacactcagagggaagaaatcaattccttctcttggtttttcagaggcagttgctgtacacagtaatgtggtgtctccgtaatgaataaatgcagcaccatttgcctgctttgctacacggttgatatcaactgtcaatgttctgcctgcaagttccattgaaaaacatttgtactctttggacatctcttatctccttttctaaactaatctggcagcttctgtccgaaacaactgaaaaaaacagttttatttttacacttataacactttacttttcttaaactgttcttttcagtggtctcggctccagttttgccgcctttgctaaaacagggcggaaaaattccgcccctggttgttactgattattttctcagacctaatttttcaattaaagcacggtatctttcgatatcagttttcttcagataatcaagaagaccacgtctctgacctaccatttttaacagacctcttctggaatgatggtctttatggttgctctttaaatgctctgtcagctcttcaattcttgctgttaaaactgcaacctgtacttccggtgaacctgtatcacctggtgttcttgcgaattctgccataatagcctgtttcttttcttttgaaatcattttaatttcctccattcatctttttaatcgcctgtaattaagaaacggtcggagtgtccggtttctgaactacggctgaactcatacttgctcagtatagcacaagatatttcacttgtaaagtcctattgtgttacaatttttcatgtaaatctgcaaaaaattgtcttccttttgccatatcaatatcaagctgtccctttaattccagaagggatgcaaatttacgttccggacgcagataatgataaaatcttacttctgcttcctgtccatataaatcttcattacaattaaacaaatatgtttccacacccagaaagttttcttttaccgttggtttataacctacattggagattccatcgtactctttttctccaattttagaacgagtcagataaactccgtttggcggaaattttttgctgactggcggaatcagattcgcagttggtactccaatcgttcttccaagctgtcttccatgcacgatctctcccctggtaaaatactgatatcccaaaagagcatttactttttcgatgtgtccctcttccagctcttccctcacataagtactactgatttctcttgtcccgtctgtcagtttttctacgacttccaccgtaaaatcatactgtgttcccatctgttttaataactcagggtttccttttctttcgtgaccaaatcgaaaatccggtccaaccgccagataagatacatgcagacgtttcaccagaaattcttttacaaattcttctgcttccatattcatcacagcatccgtaaacggacacgcaatcaaaacatccactcccagattctctgccagttcctgtctttcctcattggttaaaagagtctttgccggtttatgatacagcttcacaagaggagaaacatcaaaggtaaatacgaccgttgtacagttttcttttttcttttgtttcatgcacgcaatcagtttctgatgccctctgtgcaatccgtcaaattttccaagtgtcacagcacttctctcttgcgctttcagtacaggcacttcgtttgtgtaaatcataatgtctcctctttctgcttctaaaaatcctgcggtgtaaaaaagatggtgtgcactccaaaacattcccgtcttttttgatactcataaataccgataaaatgtctgttgctgtcatacatgcgcactctcgttttatccggcaggttctgatgtgttattgccggtactttatttccattatgaagcagtttatccatttctttcggcactacaacctcttcataatgagaaaacatttcttctattgttacaagatgagtatcaaatgtccccgcttttactgcagcctcaatcgcagaaagtttcatgctgtcttttaacataaaacgttctacctgcgtacgcagaagagattccatacaacctccacagcccagtttcgcaccgatatcatggcataaggttcgtatgtaagttccctttgaacacgttactgaaaaacgtaccaatggcagattcatttctaaaatcttgatttcataaagagttacttttcttggttttcgctcaacttcttttccctctcttgcaagttcataaagtttgcgtccgtttactttcaaagcagaatacatcggaggaatctgctcctgatctcctaagaaacttaaaattgtacgctccacctcttcgtctgtcacacttaccggatgttcttctaacactttaccagtcatatcctgtgtatctgttacaattcccaaccgaagaactgcctcataagtctttgttttatctgtcagcaattcacaaagctttgtcgcttttccaaggcagaccggaagcacgccttctgcttcagggtcaagtgttcctgtatgaccgatttttttctgtcttaaaattccacgaagctttgccactacatcatgagaagtataacccttttctttgtatacattaattactccgttaatcactgcattttttcctttatttctttttcaatctgttttagcagattattcataacatcgtaaatagacccctgcatcgtgcatccggctgcacgtacatgaccgcctcctgagaaataagatgctattttatttacatctacttttgatttggaacgaagacttactttaaattcctgtgtctttgtttcataaataaacacagccacttccactccacgggtcagacgaagctgttctacaatgccatctaactcttttgggcctactccgtaaaaatccaaatctctttttctaagacaaccaatgatgcattttttatctaacacctgaatgctttccatcaggcatcttcccagaatctgattctgcacatagcttttttcatagaaagactggtcaatgatactggaaaaatcaattcctttttccatcagctttgccacaacccgcatggtttccggtgaagtacaggaatatttaaacacaccggtatcgcttgcaattccggtataaattgcttctgccacatcttttgtgattttttcttcttctaaaaggtgaaacaacagttctgatgcagaactcatttcaggttcaatcagattttcatctgcaaacccgtgattactgatatgatgatccagacagatcgtcttctttgctgtttttaatgcttctcctgcaactccaattctgtccggtgaactgacatctaaaagaatcaacaggtcatattccgcctgtgaatcatattcctgttttgcttcttccagatttttgatataagaaaatccttcttttgctgtttccaaatagacatcacatttgatatccagttcattttcttttaaatacaggtataatcccatacaagaaccaatacaatcgccatccggacgtacatgtccggcaatggcaactgttttaatacctgctaatttactcgctaatttctccatcttcctgcacctccccagctgcatctttatgtgttacttcatcaattaattttgacatagaaactccatattcgattgattcatccaggataaatcggatttccggtgtatttcttaagtttacagtcttagcaagctgtcttctgatataaccctctgcacttcttaaacctgcaatcgtattcttttttgcttcttcatcacccagaacactaatataagctttacaggtttttaaatccggtgctacttccacagaagtaacagaggtcatcgggtgaatccgcgggtctttgatttccccacggataatctgtgcaagttccttatgaacttccgcatttacccttgtattcttaatactgttttttctcatttataaagctctcctatcttggtacttctaccataatataagcttccactttatcttcttcctgaatatcgttaaagtcctcaaatacaagaccacattcatatcctgcttttacttcttttacgtcatctttgaaacgttttaaggaagcaagatttccttcataaatctgttcttcgcctcttgtaatacgaactttacagtttctctggaagataccgtctaatacataaccacctgcgatagtaccgactccggaagctttgaatgtctgacgaacttctgcatgaccaattactttttcttcgtatacaggatcaagcatacctttcatagctgcttctacatcttcgattgcctgataaataactttatacagacgtacatctacgccctcctggtctgcaattgtttttgcagtcgcatccggacgtacattaaatccgataatgatggcatttgatgcacttgcaagagaaacatcagattctgtgattgcaccaactccaccgtggattacttttactacaacttcttcattagaaagtttaacaagactctgttttaccgcttctacagaaccctgtacatcggcttttacgataattggcaattcctttaagttaccggcctgaatctgggagaataaatcatccagagacatttttgcttttgtttcttcaagcagacgattcttgttttcagaaacaaaggtagcagcaaagcttttcgcttctttatcattttctgttgcaactaagatttcacctgcatttggaacatcgcttaaaccaagaatttcaaccggtgtagacggacctgcctcttttactctctttcctttatcatccatcatcgcacgtactttaccagagcatgcacctgctgcaatggagtcaccaacttttaaagtacctttctgtactaaaattgttgcaaccggaccttttcctttatccagttcggcttcaataacaagacctcttgctcttctctttggatttgcttttaattcttctacttctgctgttaacagaatcatctctaagagggtatcaattccttctcctgtgtgtgcggaaaccggaacaaagattgtgcttccaccccagtcttccggaattaattcatactcggataattcctgttttacacgttctacatttgcgcttggtttatcaatcttgttgattgcaacaatgatttctactccagcagcttttgcatggttaattgcttcaattgtctgaggcataacaccatcatctgctgcaacgacaagaattgcaatatctgttgcatttgcaccacgcatacgcattgcggtaaacgcttcatgtcccggtgtgtctaagaaagtaatcttctgtccgttgattgttacaacgtaagcaccaatatgctgtgtgataccacctgcttctcggtctgtaacatgagtatttctgatacagtcaagcaaagaagttttaccatggtcaacgtgtcccataacacagacaaccggcggtcttgaaactaagaggctttcatcttcctcttcttcttttaagagttcttcgatgacatcgattttttcttccggttctgcaataatatcataatcgagtgcgatttcctgtgctttttcaaaatcaatttcatggtttactgtaaccatgataccatccataaacagtttcttaacgataaccgatggctgcatcttcattttttcagccagttcacggattgtcattttttccggaagtgtaatttcctttacttcttccttcttttcttctactttcggctgagtacgtggtttctgaagtgcttttggaagtctctggtttggtcttcttcctccaccctgatttggacgttttccgcctttgttattattctgatattcatctttacgaacatcttttttcttattgtctctgtttgccttacggctgtctttttctacaaactctaacttcggaacttcaaatttgcttcctttgtcattatttctgaatccaccctgacgattgtcattgtttcttactccgccctggcgattgtcgttgtttctgaatccgccctgacgattgtcattgtttctaaatccgccaccctgacggttttcattatttcttggtccaccgccctgacgattgtcattgtttctgaatccaccttggcgattgtcgttgtttctaaatccgccctgacgattgtcattgtttctaaatccaccctggcggctctcattatttcttgagccaccctgacggttctcgttatttctgtatccaccctgacggttctcgttgtttcttactccgccttgacgattgtcattatttctgtatccgccctgacggttttctccacggttctctccgttattatagcggtttggacggtcccctgtatttccctgacggttatcattgtttctataatttctctgacggttatcgcctgtatttcttccctgatttcttgtctgtcctgactgttcatgtctgttttgtgtattatttgtattttccgttttcatgcctccctgtaccggattttctctctccggctgacggcttcctgcttttttctccggtttatgacttgcattttgcggacgaaaaacctgaatcagttttttctttggcttttcttctgattccggcattgcagcagctgtcacattcccctttctaaaatttgcccgtaccatttctgcatctttatcttccacggtactcatgtgacttttcacatctatatttttagatttcaaaaaatccattacgtctttattggtttttccaaattcttttgcgagttcatgtactctttgttttgacatatacctgcctccttcatttagctacctgcctgctctaacttttttgtcatggcctttgcaaaattttcatctgtcactgcgattaatgcccgatactcttttccaatggcccttcccaattcctcctttgttccgatatcataaagcggtacttcataaaacacacacatatcatgagcacttttctttgtattcttagaagcatcttctgctaccagtacaagatgtgcttttccctctttcacgtatttttccacggcgaactcaccgcttaccactttcccggctttcattgccagcccgagaagagacaattgtttatttagactcaagtttatcaaactcctttttgaggctttcgtatacatccggtgaaatcggcattttcaaagaacgctcaattcttttgtttttttctgccttttccagacattctttctgaaaacaaagataagcgcctcttccgtttttacgtccggtatcatctaataccactacgttttccggagtctttaatacgcgaagcatttcttttttatttttcatttcaccacaccctacacatttacgcataggaatcttttttactgtacccatgttcacctactcttcttcgctgtcaaaaacttcactatctgcttctgattcatattcatcagcggattctgcataatttttatcttccggatactcttcataagcttcttcgtaaagctcataatctccaagttcgcttgcctgtgattcactcttaatatcaatcttaaatcctgtcagccttgctgccagtcttgcattctgaccttcttttccgattgcaagtgataactgataatccggtacaattacctttgcagtttttgcatcaggatcagccaatacagaaataacctttgccggacttaaagcattttcgattaagagtgcaggattatcactccagttgatgatatcaattttctcaccacgaagttcttctacaattgcattgactcttgctccgttcattccgacacatgcacctaccgggtctacatccgggtcattgctccatactgcaattttggtacgagaaccagcttctcttgcaatactcttgatttctactgttccatcttttacttctgttacttctgcttcaaacagacgttttaccagctccggatgggttcttgaaaccataatctttggtccttttggtgtatcttttacttccacaatatagaccttgatacgttcagtcggctggaatacttctgtttttacctgttcattttcagaaagaatcgcatctgcttttccaaggttaatgctgtaattcttgccaaggcttctctgaacaataccggttacaacatctttttcttttccataatactgattgaaaattacttttctttcttcttcacggattttctgaagaatcacattttttgcattctgtgttgcaattcttccaaactcttttgatttaatttctacatttaccgtatcacctaaatcatactgagagttcattttctttgcatcttccaggctgatttccaataccgggtccaatacttcttctactactgttttctctgcaaatacaccaaactcacaagtctgcgggtcaatatttacttttatattatcagcttttccaaaatggtttttacatgcctgaattaaagactgttcaattgcttcaagcagggtatccttgctgatagatttttctttttcaagaacgttcagcgcctctagtaactcagtattcattttttatatcctcctaaatcttctctttttctttaaaaatcaaatgccagacgaatcagtgcaatatctgatttctgaaaagtctgttcgccatcttcattttcaatggtaacactgttttcatcataagattttaaaataccataaaactctttttcacggttgattgcacgatacgttctgatttccagttcttttcccatgctccgtttgtagtctttttctttctttaatggtctgccaagtcccggggaacttacctccataatataagcatcatcaatgaaatcctcttcatccagtttatcggaaaatgcacggcttacgacttcacagtcatccactgaaattccaccttctttatcaatataagctctgagataccagttacttccctcttttacatactctacatctaccagttcaaaattgtttgcttcaataatcggaagcagtaatgcctctgctttttgttcatagacttctttcttgctcatcttttcaccttctctcccattttccgttatacaacaagagtggaccttttcggtccactcttatgctatcgtagttatcaagttctttatcagcataacactattattcccaacttgcaagtcttttttaccaatacaccgtaatcaaaagctctgcatcactgcatccgacgttccacctgtagctgttttctccatcaaaagagtaaaactcctgaactgcctgttcaatcagatttccttctgcaagcgcactgactgcctgctgataagcttcttcatttgcaaacttaaaatcttctttttcccgtttttctaagatagaagcttttagtacctgataaatctgtgattcatcataagactcataccagctctgattctgtttataataattatagctgtcatctttacattccggaagcgtaagattgtcatccggtacatgacttctctccagcgtctgtgcagtacaacacagatatgtgtaagagaaatcctgaatactatcctcttccggcacaaatccggaactgctccaggtcgtatctacataataataattttctcctatccgcaccagattccatgcatgctccatgttttccggaataacttttccagttaccaaagtacaaaagattccatttcttacaagcagatactgtgtcgctttggcaaatcccatacaaaccgtactttgatttaaaaatacactctggatattctgattgttttcactctcactgtcataaagcacattcttcccaaggaactcataaacatacttaattttatcatattcgttttcacagtttgaaagttcctgtgaccattcctctgcttttgcttctatctgctgttttgtgtcttcaatctcatcttttcccatgttatagaccagattcaattccagcaaatccacatcggaattttctttttgattaaacgaataattctgctgttccagccagaaaatttccggatggtctacaaaaaccagattactgactttgttaatctcttcttccgaacaagcctcgacagtcacagaatcttcataattttcaattcccgcaagaatctgacggtatcttgttttttcttcttcatttaagttctgatacccataaagaaacggctcttcttccggtgtaatctctgcctccggaagtgtatcctgttctttttgtacatcactgcttgaggaaatcggtatcttgtcttgggtacatccacataagctaagtatcagaacaagtgtaaaaattccaaacctgtttcgttttttcatagatgattcctctcaattttttacactcttgtctttgttccttttccatctctctttgccagtttcagccgatttaatgaaacgctcttgcccttataatccgccgtataatctgtccggttttctaacaaatacgcatgctctacttcatcttttgcgcccaatgtaattcctcttactccaagtgctgcttttttctttaacggtacttctgttttcataaaacgtaagaaatatccctcttttgtctgaagtactacatattccatttcatctgccggttgaacgaaaacgactttatcaccctctgccagctttgttgctgttgttgtcctcttggaaacctcaaattcagaaccttctactaattttaccattccaaaagcagttgcaaaaagcatccgactctgcttaatctgatttaaactttccacataaaccagctgctctttcttgctgtcaaaattgctgacattatcaatcggaactcctttatctctcatttttccataaggtaaatctaacacttttatagtatgcagacatccggtatctgtaaatacacagattttatcggtattcatacaatggaaaatatggcggttttcctgatgaatggtttctttatttctttcataaaccgactgatctaccgtttttgcatagccaaaacgatccatcaaaaagacaacttctgcttcttctattttcttttcttcgtacaccgcttctttggcattttctatctgtgtttttcttggttttccataggctttttttactgcctttaattcttttataatcactgccgccatggaatgataatgatttaagatatcctcatactgtgcaattttctttaaagtctcttcgtgttctttcgtcagtgcttcaatttcaagcccgattaatttatacagacgcatgtctaaaattgcagttgcctgcttttcggtaaatccaagttttttcgcctgtttttcactggttttcgtgcggaaacggattccttctgttgctccgtttaccagacagtttttcacctgttcccgatttttactgcctcttaaaatttcaataatcaaatcaattacatcgcaggctttgattaatccttcctgaatttcctgtttttctttttctttggaaagcagggtgttatattttcgtgttgtcacttcaaactgaaaatccacatgatactcaataatctgctttaaacttaaagtctccggtttaccatttgcaactgcaagcatgttgaccccaaacgtatcttccagacgtgttttcttatatagcatattggtaagattttcaatatctgtaccttttttgagttccaatacaatacggattccctcttttgaggactggtttgagatatctacaatatctgtcgtctttttggattccacaagccctgctacatcatttaaaaattttccgatgtttgcaccaatcatcgtatatggaatctctgtgataacaagcaaatttcttcccgctttgcctttttcgatttccacttttccacgcagcttaatctttccggttcccttttcataaatcgaaagcagttcgtctttattgactacaattcctccagtcggaaaatccggtccctgaatatactgcatcagttcttcatttgtaatttcgttgtttttcatataggcaatgacgccatctaccacttcatttaaattgtgaggcggaatacttgtcgccataccaaccgcaattccgtctgctccgtttaaaagcagattcggaacacgcaccgggagcacttccggctctttttctgtctcatcaaaatttgaaacaaagtcaaccacgtctttatctaagtcatttaaatatacttcctgtgtaatcttctcaagacgcgcttccgtataacgcatggctgctgcgccatctccctcaattgaaccaaaatttccgtgaccatctaccaaagcctgtccctttttaaattcctgtgccatgacaacaagggcatcatagatggaactgtccccatgtggatggtatttacccatcgtatctccgacaatacgggcacatttacgatacggtctgtcataacggattcctaattcatacatatcataaagtgttcttctttgtacgggttttaatccatctctgacatccggaagcgctcttgatacaatgacactcatcgcataatcaatatatgatttctgcataatttccgaatattcagttctgataatattatctgcgtttgccattttctttccccctatacatcgagttctgcatcttgtgcatgttcatagataaatgcctttctcggcggcacttctgttcccatcaggatttctgtaatatcagatgccattcttgcatcttcaatttctactaattttaacaatctggtttccggattcaaggttgtctcccacagttgctgtgcatccatctctccaagacctttatatcgctgtaaggtaaaggcacctttatgtgtctttcgataacgctccaatgccttatcatcgtataaatactcttcttttcctcttgccggcatcgctttatataaaggcggcatggcaatatagacatgtccctcgtaaattaattccggcataaagcggtaaaataaggtcagaagcagcgtagaaatatgcgctccgtccacatcggcatccgccatgataataatcttgtcatatcttaacttcttaatatcaaaatcatttccatatccttcggaaaatccacagccaaatgcgttaatcatagtcttgatttccgcatttgccagcaccttatcaatgcttgctttttctacatttaaaatctttccgcgaatcggaagaatcgcctgaaaacttctgtcccttgcagtttttgcacttccacctgcggaatcaccctctacgatgaaaatctcacagatagatggatctctcttttcacagtttgcaagttttccattggaatcaaaagaatatttctgttttgtcaacagattcgtctttgctttttcttctgtttttctgatttttgcagatttttccgcacaggcaagaatgtttttcaaggtttcaagattacgatccatatataaaaccagttcttctccggttacttttccggttgcctttgaagcgtcctgattatccagttttgtcttcgtctgtccttcaaatcttggagccggatgcttaatagaaatgactgcagtcatcccatttcgaatatccgagccggtaaagtttgcatctttttcctttaaaattccaagttctcttgcataactattcattacagaagtaaaggttgtcttaaatccggtcaaatgtgttccgccttctgcattgtaaatattgttacaaaagcctaagacattttcacgaaattcattgatatactgaaatgctacttctaccgtaattccatccgattcacctttaaaataaaccggctcatgaatgacttcacatttcttattcatatctttaataaatccaacgattccatccggttcatgataagtaatttcttcgacttcttcacctcttttatcactaaaatgaatcgtaagattcgggtttaagtatgcagtctcatgcagacggctctttacttccgtcgctgaaaatttggttttttcaaagatttcaggatccggtaaaaaatttacctctgttccggtttcccttgtttttccaagagttggaagcagcccatcttccaactcaattgtcgggatacctctctcataatggtcatgatgcacatagccttctctgctgactttgatatccaaatacgtggataaggcgttaacaacagaagaaccaactccgtgcagacctccacttgtcttataagcggaattatcaaatttacctcctgcatgaagtgtcgtaaataccagtcgttctgctgaaattcctttttcatgcattccaacaggtatgcctcgaccattatctctaattgtagcagaaccatctttttcaagcgttacaaaaatattactacaatatccggcaagatgttcatccaccgcattatctacaatttcgtaaatcagatgatttaacccttttcttgaaacacttccaatatacatacccggacgcttacgcaccgcttctaatccttcaagaactgtaatactactggcatcgtaagtattcttttttgccatttctatttcatttcctttctttttctgtctttattttaatttttctcttcaacacctcttgatataccacgcctgcaagcagtccacagattactccaattccaatccctgctaacacatctgtcggaaaatgtacatataaatacaatcttgaaaatgcaatcaaaactgccagaataaatgcacagactcctgcttttttattcacatgaaagattgccgttgcagaagcaaacgatgcctgtgtatgaccagacgggaacgaataatcttttggcattgcaactaaaaggtgcaccgattcatttatccagcatggacgctctcttgcaaccaatggctttaacatcagatttgcaaaaagtgcagaaaaacataatgccgtcaaaatcaggattcctgtctttctgtatttttttgtaaagagtaataaaactcccaaagcaatccagaaccatcctgcatctcccaaaaatgtcacacctaccataagtttatctaaaacaggtgtatgtatgcattgtaatgcatcgagcaatgtaaattcccagctcatttttctcatttcctttctcttaaaaatgccgctgattctatgttcagatttttacgcgctatttttctatcatatcctatttcgtcttgtttttcaatttcaaaaattgtatggattaaaatacaatatttttcaaaaaaatgcttgcttttttattattttatgtgtattataagtgagtacggttcgttggtcaagcggttaagacgtcgccctctcacggcgaaaacaggggttcgattcccctacgaactgctgagttgaaagcatgaagaattagtcttcgtgctttttttatgctttcttttcccttttattgacagtcttattatcctactatacactatacttagtgtttattttatataaaaaagaagaaaggattttttattatgtctcaatcgaacacaaatgaaaacaaaatgggcgtacttccgattccaaagcttctgcttcagatgtctctgcctatgatgctctctatgcttgttcaggcactttataatgtagttgacagtatctttgttgcccgcattaatgaaaatgccctgaccgctgtttctctggtttttccggttcaaaatctgatgattgcaatcgcagtcggaaccggagtcggtgtcaatgctgtactgtcacgaagccttggcgaaaaagattttcatactgccaatgaatcagccaaaaatggaatctttctggcactcatcagcagtattatttttgcaattctaggaaatattgcggcaacctttttctttcacatccagaccgatgatgctcaaatccgccagtacggtatttcctatatgaccatcatctctacgatgtgtattgccgtttatatgcaggttatgatggaacgactcttacagtctaccggccgtactttttacactatgatttctcagggtacaggtgcaattattaacatcatcttagacccgattttaattttcggattatttggtatgccacgccttggcgtttccggtgctgccattgcaactgtctgtggacagatttgcggagcacttttagcctttgcctttaacatcaaagtaaatacagacatcaacctgaatatgaaaggcttccgcccaaacaaaaaaattatcggtacgatttattcggttggtgttccatccattgtcatgcaggcaatcggttcggttatgacatttggaatgaacaaaatcttaattcagtttacttccactgccactgcagtctttggtgtttactttaaactcaacagctttatttttatgccaattttcggtctcaataacggtatggttccaatcgttgcttataactacggagccaaaaacaaaaaacgaattacgcacacaattcgcttaagtattgtcagtgcaatctgcattatgcttttggggcttgcattatttatgatattcccggctcagcttttaggattatttaatgcttcaggctctatgcttcaaattggtgttccggcgctcagaattatctgcttaagtttcacctttgcaggattttgtatcgttgtcggttctgtctttcaggcacttggaaacggcatatacagtttaattatctctgccacacgacagcttttaattattcttccagttgccgcactgcttgcaaaacttggtggtctctccgctgtctggtgggcaattccgattgcagaaattgcatctgttcttttaagtacatttttcttccggaaaatttataaagaaaaaattgcaccacttgggaaagcttaatattttaaactaaaaaactgctgttaagttgaacgataacttgacagcagtttttttgattgaatttggctgggtgtcaagtagcagtcagttccaaaatcaatatgaaccataccacctacttcactttttcattagcttatcacaagtttctgcctgttcccttaatacacgaatcagcagctggtattcactgacatcatcaaaaataccattgcagaggtcttttattgcttttgcctcttccaggacttttcaatcctacttaaggtatcctcactgcggctgtggtagataaatagtagtatcatttgtaacaaaagacatcgtaagacctcccagataagttctggttatattttaacagataatggatgatatgggtatggtatcatgtgttaaattttcaaggtacaaatctaactgaataggtacgagcttttgacgcttaaatcattatatagtaatatatttaaaaagcttgaccttaaataacaaaatatggtatatttcaatcagaggttttgttgtatgcaaccaatgttagtctagtataactacgtaaattttttattataaaaatactagtgacaaaattaaatttgtcactcacatcttattattaaatataagcacaaatacaaatattagtagctgaaatattaaaaagattataaatgaggtcattatgaaaaaaaaacttgcagtcatcatcatttttatatttggaatatttatagtagtaggaaacttgtgtaaaccaacagatttcagtatagaaggtaaagttatagaaaaatatgagaaagcatttctgttagaaacagatacctccgataaaatactttgtaattgtccgaaaaattatgatatttcacaactagaaatcaatgataaaattacggtttatttcaatggtaaaatcttagagacttatcccgcacaaataaaaaaaacaaccaaaatcaaaaaataattaaaaattcttgcaaacaagagaggaggttgtatgaaacaaattcgattactttttcttggagtgatacttagtattatgacatctataagtgtatttgcaaatagcaatgtggtagaaaccgaaatcgaacaaaaaaattgtcaggatataagcaaaaatatggaaaccggagaaattcttttaaatgagatacctacaactttaaataatcccagtagtggaactacagattcttttataccaagtggaataaaagaagataagcctttaacaagagaaatcattggaaaagataacagatataaaataacagatactactacttttcctaactcagcaatttgctatgcagaaatgaaatttcctaattcagatagcatttacgttggaactgcttggatgtatggcaatcgtgttgcagtaacagcagggcattgtgtatatgactcatcattaggcggatgggctgaatgggttagaatataccctggaagcaatggaagtgaatctctatatggagtctattatgcatctgtgttacatactgatactaagtatgtaaagtcagaaaattccaactatgattgggggcttttagaattcacttcaaacataggctctcaaacaggatactttggtgcttcatggacaactgacagtttagtaggaacatgggttgtattaagaggatatccagcggaaaaatctgcttgtttatggacaatgagtggaaaaattgcaaccagtggtacttttaaattaggatattatatagatagtacaggcggacaaagtggctcaccaatatacaaagtaactaatggaaattatcaaagccttggcattcatacaaattattcacctacaaatgaatataatgaagcagaacgaattgataaatcattgtttgaaatcatgaatcaatatagataagatacaatatattaatggttgttgtttgcaagaattgattattcaaaaattctgaaatttgatgctacatgttaaattccagaatttttttgtataataaaaaaggtaaaacattagctgatgctaattaatatcactaatgttttacctttttatcataccaaaatccagaaaaaaataatttctgcacactacttcttactctgcttactctatttttattcttccggtgcttctgccggaacgaaaatccgtttatctgccgcagtttccggcagtttgatttttgctcttctggttgcttcttcacagaaaaagtcctgtgaatttagcagcattttgcctcgtttatctactttctcatacgtgccatccggctgaagaatatgtgcttttacattatcttccaattgaatctgtaagatatgtttcacttcttcttttaactgttcatcttctaccggaaatacaatttcgacacgtttgtctaagtttcttggcatccagtctgcacttcccataaagatttcttcatttccatcgctgtagaaataaaaaatccggctgtgttccaggaagtttccgacaatcgaacgcacggtaatgttttcgctgattcccggaattcccactttcagacagcagattcctcgtacaatcaagtcaatctttacacctgcggcacttgccgcatataacgctgcaataattcctctatcgcaaagagaattcattttcgccacaattctggcttttcgtccttctaatgcattttttctttcgatttcaattaaatgaagaaatctgtctcgcatccagagcggtgctaccactaatttattccaggttcttggttctgaatatccggaaagcatattaaagactgccgttgcatcctctccgattcttgctgaacaagtcaagataccacaatctgtatataattttgcagtcgaatcattatagtttccggttcccagatgcacatatctgcgaattccattttcttctcttcttactaccagtgtaatcttactgtgggtctttaatccaatgactccataaataacatgacagcctgctttttcaagcatttttgcccagacaatattattttcttcatcgaatcttgcctttaattccaccagtaccgtaacctgttttccattttctgccgcctgcgcaagcgctttgataatcggtgaatttccgctgacacggtacagggtctgtttaatcgccagtacattcgggtcttttgccgcctgctgtacaaaatctacaaccggatagaaggtcatataaggatgatgcagtaaaatatctccctgtcgaatctgggtaaagatatcctcatcattcatcattgccggtacctgtgccggaatgtatggttttgttttaaattcatcaaaacccggaagcccatacattttcatcaagaatgtcaaatccagcggaccattaatcttgaagatatcctcatctttaatctgaaattcctcttccaaaatctttaacagtctctcatccatccgctcttccacttccagacgaatgacctcaccccactgtctcttctttaactgtttctggatttcctttaataagtctgctgcctcatcttcatcaattgtaaggtctgcatttcgcataatccggtaagggcaggtacaaaccacagcattacttaaaaacagtttattgatatttcgctcaattacttcttccagtaaaatcacaaccgtatttccatctttatcatccggaagctgtacaattcttggaagtaccgatggcacctgaaccgttgcaaactccaactcttctttcccttttttatcttttttggaaattaatgcaccgatatttaacgttttatttcgaatcaatggaaatggtctcgcagaatccatcgccatcggagtcagtaccggatacacttcatcttcaaaaaaggtatcgacaaactcctgctgctctttggttaagttttcatgatgctctactacttttaaaccaatctttttcagtgccggcaaaagagaacgattgtaggtattgtactgtgtatctaccagttcctttgttacttttgaaagtgcttttaattgctcttttgcagtcattcccgcaatatccgttttggtatattttgcatgcaccatatcttttaaagaagcaacacgaatcataaaaaattcatctaggttcgatgccgtaatactcaaaaattttaatcgttcaaacaacggcagactcttatctctcgcctcactcaaaacacgctcattaaattttacccagctcaattcacggttagtataatattccggctttgtatattctttttcgttccattgcattttttccacctactttctctttttccgacgtaatacaggacgaatattgaacatttctttaaagaaatctgctttctgtgtcagcagcccctcctccaacaataagttttcctgtgtatcaatcacaagtaccagctctttatcctgaagctgtacttttacattctctgctttttgtttatggcttcgatccaatgcatttgccactcttaaaatcgcagtcagctttccaattaccatatacgtgtctcggtcaatggtactctttgaatccgcttcgccataatatttaaatggctcattgttaaaacgcactatatttgcaatcatctctcgctcagcgtgcgaaagcccgataatttcggtcgacataataatctcatacgaacattttgcgacctcactcatactgatatattttccacaatcatgcaaaatgactgcaatctgtaaaagcaggcgctctcttggtcccatcccatgcactcttctcatactgtcaaaaattgtctctgcaacctttaacacagcacgcacatggctcttactgctcatataacgctttgcaatattttgtgcacaagctaaaatatcgttttcaaaattatgggtactacgaatcaaacgtctgccctgtgcataatcataagcaattccgtcatttagctgtgttcccggaacccacagattctgtgcccccatctcatctgcaaaaacacgataaatgatcaaagccggaaccaggatacttgcatattccagtgtaattccaagttctaccgataactgctctgcggatttatgcacgattcgctcatacatctccataaaaactgctttactaacggtacgactctctcccattccataatcgctcaccagcaatttttctataaagaaatcgcccaataaaataatattatctacttttcgctcttttaaatgaagtttcttaaaacttaaaatgtcattatgaattaactcttctactaatttttcataataaatagtttctttttcgacagagagcagacgctcacggatacgaagacttcccatcttaaaattctgagttgtcacaagcgtatctttatcaaataatgaaatctgtacatttccaccgccgatttctatgattgcagtccctttctgaatgatttttgaaaaatctgcttccttagctgcaatcgatttatatccaaaaaatctctgctcagagttacttaaaatttcaactcggattccggttctttgataaacctgctccagtacgatccagacatttcttgcttcctgaagggtacttgtcgcacatgcacggtaagaagtcactttatactctttcataattctggaaaaatctccgagtacttcgcctaatcgctgtgcagactcataactaatttttccattggtataagtgtcatgtcccagctcgattctgctacgcacttcatctatcttttcaattccaatttttggagaaatctgatagatatccatactgacttcgtaagaaccgacatcaattgccgcaaatattgttactgccatttttccaccgccttacattagtttgctgtttaattatatcgttgtaagttgttgttttcttctaatctctgttaaattcaggtaaattttcttgaaaattcgtcttttttgtcttttagttctcaagatattcttttagtgcttcataataattctgtgcagtttcatatccatcttcatatagtttgtgcagcttatccgtatctctttcaagtcgtccgatttcaaccggtttttgtggctgtaaaataaatatttttccctctttttcctgacggtataaataatccagtgtctgattatacccaatgtggcggttttccaaagcttctatcagttttggaaacttctttccataacggactttcattgcaggaatcaacttatttttttctttcctgtaagttctgtcacgagtcagtaccactacatttttctcatttcccattctctgagcttccataatcggaatggaatctgtaattccaccatccagatacggctttttatgaatccagaccgttcttgacataagaggaagcgaacttgacgcacgaacataacaagtgtcttttttcatatctttgatttctttgtactccgcattcccactttcacaattggtaacaaccgcataaaatttggttttttgtctgttatatgtatcgtaatcataaggattcaatttttctggaattttacggtatatcatatccgtgccaaaataatctccggtctttatcaggctttttattccacaatattccgggtcatccatataatcagtaaatgtatggtaccctctgcctttttgtttagaaagataactgcatgccatacatgctcccgctgaaacaccaaagcaagtatcaaattccagacctttttcaataaagaaatcaagaattcccgcagtgaatacaccacgcataccgccaccttctaaaattaatcctgtttttgtttttttactcatgctgtcatcacctttttttattatttatttaaaatcattttacgctttttgtaagatttgtacaaggtaaattcttgtaaaaaaaagaaaccggccggggccggtttctgatgggtgaatattagaggtttggttttgtagatgcttttacatgtctgttatagcgttaagaggtaagagtagaacttacatttcatctcaatcctctcaattccgctttctgttcttccgtaattcgattgctttccatcgctttttgaattgtcttcctatgcacccattccggcaacttccggtcttttagatatccaatcacagcctcccattgctttgcaagcgcagtcgcaaaataccaagcaatcatcatattgacataatattcgtccgaaatcacagctgagacaagtttcggatattcatctttaaaatcttcatctaaatacagccgtaatagcactccaattccataccgaatggtatacgtatcatttgaagcaatccaattttttacatccacaatcaattccgctttgtgtttttcaaaacattttggtaagggtaaatcacaggttgcccaattatcaatatagggtaaaaattgtgtcacttcttttaaacattttttgtagtcgcaaatctgtgtcacaagcatcaaatgtaaattattttcctcgtaatactgatgaggaagttcttgtaaaaagttttgtgcttcttttgtttgggcaaactctttcgcaaatttacgaagaatcggtgtacgaactccaatgattttttctttttctgtcttcggtaacaacttgctttgaaaatcacgatattttaaatcttgtagttcaaataaacttctttgtagttctgtcatatgttgtttttttacctcgtctctgctttctgaataataaaggttgcagatgtgttttgattagatgttgtatttctatttcgttcctttttttacagatgcatttctattattttattaatgcaaatgtatctttagtttaggtattcttaagttctgaggtacttttggcgaactcgaataaaaagaactgatggaataacaaaaaatgagtttcaatccctcataggtaatatacaacaacagtatttccgccatttctaattctcattatcctctaatcacccattttttgcaagttttttcacaaaaagtcagtcaatctctttttagaaatcactcattttccttgattttacaacatttcttagaaatcgccaaattcaccttgagactgaccgactttttaattccttccttttattttgcttaagctaactttctttccttaacaataatgaatcccatcccagtaaacacattcttttactatcgtctccggcagaaattctaccccttttaaagcatactccttaaatttttcaaatccaactctatcaataatatatccaatatgctcttttctcgcaggtgcatccggagagatatactcttcaacaaatttatacgtattcttaataatcctaataatgttttcttcatctgcccacacaagaaaatcctgtccaagtcttggatttttctttccggttcttcccataatggataatttgtaatattttttcttacttcttgtccatgctctggtcggacattttgtgacacagaccccacagccgatacatttttgagtatctctttcaattcgataattttccatacgaagtgcgcccactgacaaactgttacagccttttatgcacgcctggcagctgacacagcgggctgcatcgtactgtggcattgtcattccgataattccaaaatcatgcattcttgcttttgcacaatcattggaacagcctgtacatgcaattttaaaatgcaggtcgtttggaaagatttctttatcaatttttcttgctagttctgctgtattataattagcaaatggacagacattattcccaatacatgcctgaatatttctggtcccagatgcttcgtatcctttttcacgattcgtttcagcttgatttgtttctaccagctcaataatcggctgaagtttctgatttactacttccatatcttcaagatggattccttctatctcaaatccctgtcttgttgttaaatgtacatatccatttccatattcctttgcaatctcctgtaccattccaagcacatcggcatttaaatatccgcctggcacacggattctggatgcgccgattcctcgttcttttgtaattctccaggcattctttttcgctttttttgtattgatatccaaactcatttcgcttctcctaatctatcaattccctggcttctgtataattaaataccggtccatccagacagacatatttttcattcattctgcaatgaccgcattttccgattccacaacacatttttctctcataagaagtccagatctgctcatctttaattccaagtttcttaatttccataatcgtaaatttaatcatgaccggcggtcctacgcagataaataccgcattttcaggatttttaaatctcaaatccggaatatatttggttaccattccaaccggaccttcgtatccttccgatgctgcatctacggtctgaattacatgaaatgtttttttccattcttcaaaatctttcttaaacagcacatcttccggacttttaaatccagcaattagtgttgtactgactgcctcctctggatgagctgaaaaatactgaatcaccccacgcattggagaaactccggttccgcctccaataattacgagttccttccccttataattttccagttcaaacccattgccataaggtcctctgataaacaatttatctcccacataattttcaaatacctcgtttgtcacagttcctactcttcggatggtaaaatcgaccagaccatctccaattccactaacagaaatcggagcttctccatacttcggaatggaaagttcaaaaaactgtcccggttttacttctccatcatactccattcgaaaagtatattccaaatccgtatgttttatcacttcttttattttggaaagcttaggaatgtattcattcttcatttcttttttcctccttgctcaaccggttaatcagatttgaataggaaatatactctgggcagacactgtcacatcggccacagcctacgcacatcggatatccaaaccgcttctcataatgataaattttatgtaaaactttaaaacgtaccttatctgctttttttgtacggaactcatgcccgcccgcaatcgtatcgtatttatctacctgacaggatgcccacactcttcggcgttctcctgccttttcattatctttataaaaaatatcctgcattgtaaaacaagtacatgtcggacagacaaaattacaacgtccgcatccgatgcaacgtgctccatactcttcccagattggaagcttggcactttcttttgataaatgttttggaagttctaccttttctaaatttgcttgtacaaattccggtaacacctctgcttccggcatacctttgaaatatttctttaactcttcatctgaaacatcaagacagacacggttgtttttcaattttaaataggcatcatagttctcgcttttgttggttcccatgctgacacaaaaccctgtttcacaactttccttacatcccatcaagataaattttgcttttttacgcattctcgcataatagaaatcttcttttccactctttaaatacatttcatccaatcgttttaatgcgtgcatttcacaggaacgaagaaaaatgagcaaatctttttcctgctctttcggtacgattgtctcatcttctgtaaaataaaaaatcgtctctctgattttaagcagcgattccttaaaagaataatctgaacgcttttcccattcaatttcatccaaatcttttatcttatcatatcgaatcacatcgatttctgagaaggttccctctccttcttttcgtaccggagcccagatatcatatttcttttttatggactcaaatatttctgaaaatgcttctctagctaactgatatcccataatcgttcctttcttcttactatttctatttttttatacaaaaaaatctttgttaatatcattttatcaacaaagattttttctttccgtgataatcatcacgttttattattctttttcatgaatttttttcaacaacttatcaatatctggaacgagaatcagcttttcttgatattcaattaagtttgattttttcaaatgtcccatcactcttgagacggattctctttttgcccctagcatgtctgccagaaatgtaatcgttactttaaatggaatctgtattcccgatggagtctctatcccatagtctcgagccaatttccagacctttgctataatctgcttttcaagcctaaatgaatttgaagtgttcgccagctgatgatacattttacgaattttctttgtgcttgaatagaccacttctcttgaaaatgctgcatcttccatatagtccataaaatattttcttggaatctttaacataagggtatcgcaaagtggctctgcactgattgacgcgattggtttttctacaattacttcatttaaaagtgcaccatctgtataaataaagatatttttccggtctccacggtgattatgacggtacagcaccacatagccttccacaatgaagtataatgtatctactcgttctcgctcccgaaaaataggaacacctttttcctgaagcactatttgtccgttcttttgcactgattcttttattgtttcactcgcattgttaagtatcgtacacttttggattgcttcactgatttccatttttctaccttacccctgataccctgcaagaaactgtgcaatcaactcaatgcacccttccacatctttttcatctgccacttccgccggcatatgcatatagcgcagcggaatcgacactaacaccatcggaacaccctgattagaaaaatgaatttgatctccatcggtgtaggaaagtctgcttgccgcttctctttgcacagaaatgcctgctttctttgcacactcttccatcttttcattgagtgcttttaccacaatcggactgttacaaagcaccggtccttctccaaggcataccgttcccatctctgccggatccattccactgcaatcacttgtatatgtaacatctactacaattgccatggtcggctgaattctggcactggtccaatatgctccggtcttggttgtctcttctcctgtcgtggaagctgcataaattccaactttacatcccaactcttttgatcgtttctttttcaaaggagaatattatgcagaaaaaagtaactttgttaacactcatcatcgagttaggcaaactactcttaagtattggattgctcgtaagcactgtagttggattatatctaatgttttttaagttttagaaaaaatacaacaaaaaagtccttgcttccaaggacttttttcactgccgctggccggactcgaaccggcacggtgttacccgcttgattttgagtcaagtgcgtctgccaattccgccacagcggcaagctgatttgtttggctgaatcgtatattataatatcatgctttgctacacaatgcaagcttttttttaatttttacgggcagattttttattttctctgcccgccttgtcttttttactgctgaatcagcttatcatagatatcaaaacagtcaaatgttgcaaaatagtcttttggctcttctgctctgcggattaactgtgtgcttccatcttcttttaataagacttctgctgatttcaattttccgttgtaattatatcccattgcaaatccgtgtgcaccggtatcatgaattaccagtaagtctcccatatcaattttcggaagcatacggtctactgcaaatttatcattgttttcgcaaagagaacctgttacatcatatttgtggtcgcaaggttccttttcttttcccattactgtgatatgatggtaagcaccatacatagccggacgcattaagtttactgcgcacgcatctacaccgatatattctttatgagtatgtttttcatgaattgcttttgttacaagacaaccatacggtcccatcatgaaacgtcccatttcagaatagatttctacatcacccattccagccggaacaagtacttcttcataaactttacggacaccttctccaatgacacggatatcatttggtttctggtctggtgtataagggataccaacaccaccggataaattgataaatttaatatttgctcctgtttcttcttttaattttacagcaagttcaaacagacgttttgcaagttccggataatattcatttgttacagtgttacttgcaaggaaagcatgaataccaaattcttctgcacctttttcttttaaaatacgaaacgcatcaaaaatctgctcggttgtcattccatattttgcatctcctggattatccatgattccatttccaagttcaaatgttccgcctggattataacggcagctgattctctttggaattgttccgatagtatcttccaagaaatcaatatgagtaatatcatctaagttaatggttgcacctaatttataagcataagcatattcttctgccggtgtatcatttgatgaaaacataatatcttttcctgtgcatccgattgcagaagacatcataagttctgtataagaagaacagtcacagccacagccatactcttttaagatattaatcaaaaatggatttgggcaggcttttactgcaaaatattctttaaatcctttattccaggaaaacgcttcttttactgctttgatattttcacggattcctttttcatcatacagatgaaatggtgtcggatactgttttacaatttcatccaactgttctttagtaacaaatgtttttttctccattttgttctattctcctcaatttttctctctaatcacatatacacggttattatatgtcacatgctttcatttttcaacaaaaattttgcagattaaagtgataaacaaaatcattactgatttacgatcacccaggaaaatgcttttgcagttcttttctctgcatctttaaaatgatttccttgattccattccaaaatacacttcactttattttctttcataattttctccacttctctaatattatctccaactgttgacagcatcgcatttttggttttgtcttctttgtctccaagactcaaatagatacatggactttttacttcattttctttcagataagtaaggaatcctggaaaccatactgacggtgatgcagccgctatccctgcaaatttatcactctgacagcacgcccaaagactaaatagtcctgctaaagaatatccacccagataatattttttatttttatctgagcataattgcggtatctctgtaagcaaatttgatgctccatcaccaaatgcttcttttccaaatactgccggtgctttccatggtgataattcttgattccagttatctacctttattgcaagcatttgtatctctttttttgtatttatttttattcgttcaacttgatttggtatttcattcagattatgagttccaacaggttggattagtacaatatttgattctggatttccatatttatatagcttcattcaaacaatttctcctcacatctttcattcaaattcctgctttttatcattagaattctataactatacgccaccacttttcatttgctgaccgattttcactctaaaatttccactcctgctaccaccccattacatgatatctttcttttgatgcagtatacattactattcctcctatactctcaaattctttcgggttgtttttatactacttatgttgtaattctttttacaaacatcaattcatgcctttattatacattaaaattttctctactcatactacaaatatttatgctacaaaaggagctgtccatccggacagcccctcctatctgtttctatctctattctaatcgattcttattttacctcaattacatgaagcatattggtaacattctgttcatttacagaactgtttgttgccgggtcaccggcagttaagactactaactgaccttttttcaccagacgtttgcgttttactgtttccattgagttaagcaaaatattttctgttgagtcttttgtataaccttttaatggttttacaccccagtaaagctgcatcttatgctgtacagattcgtttggtgtaatcgcataaatcggcattggaggtctgaaactggataccagacgtgccgtcttacctgacattgtcggtgtaataatgcaggctgcctccagatttcttgctgtacgcacagaagagattccaattgcacttgaaatttttgtcttccgatacatacttctgtgtgtaacatatttatcataatctacatactgttcggtgctttctgcaacttctgccatcatctttaaggcttctaccggatattttcctgctgcggtttctccggaaagcataacagcgtctgttccgtcataaattgcatttgctacatcgccaacttctgcacgggttggacgtggattacgaatcatggaatccagcatctgagtcgcagtaataaccggtacatatttttcattacatttctgaatgattgttttctgaatatgtggaacttcctgtggcggaatttctacaccaaggtcgcctcgtgctaccataattccatcagccgctttgatgatttcatcaatattatcaacaccttcacggttctcaatttttgcaatgattgcaatatgctctgcatgatgttcagttaaaatcttacgaatttcattgacacctgctgcatttctgataaaagaagcggcaataaaatcaatatcctgagaaattccaaagataatatcatttttatctttttctgtaattgccggaagtttaatttttacattcggcacattgattccttttttctctccaagttctccgccattttcaatcagacagacaatcgaatctttctttgttgcctgtacttcgagttcaatcagaccatcatcaatcagaatcttgtcacctttttttacatctttcgcaagaccaggataggtaatagaacatcctttttcatttcccacgcactcttctatataaagagtaaaggtttctccctcttttaatgtaactttctgtccgccttctaaaactccggttctgatttccggacctttcgtatcaagaagaattgcaaccggtcggtctaattcctctcttacgtttttcagcagattcatacgatttttctgttcctcatagtcaccatgcgaaaagttaaatcttgccacatccattccattttttacgagtgcacgcattatcgtttttttatcggtatttggtcccatcgtacatacaatctttgtcctgcgcataatatcatatcctcctgattatttgatatgtgtatgtgtaaataaatgttcctgacaatattcatagtttccattgcatttggaacagaaacgaaattccaaatcgtccccgtcattttctgttctgccacaaattgcacatttatgttttgttatatttggtgtcatctttggatgaaccgccttcttaaactgctgttttctgtgtatttcacgtggcgaaatcgttttataatttcttgtcataaagaagaaaataataaaattcagtaacgacacaagaatcatcatacggacagcccatgcaccatatccggatacacgaataaagttataagccagatatgcaatatcaagatatgccatccatttaatcttaatcggtattacaaaatataacagtacctgcatatccggataatttgccgcaaatgcaaggaatattgacaagttaatataatatgtcgaaattatgcttgctccataaagggaaatctgaagtccgccaatgaaatacagcaagaaagctccaatcacagtgaataaaattccactgaaaatgtacacgttataacggaactctccccatgttctttcaagcgctgttcccagtgaataataaaagatcagcataataattgtaaaaatatccagtcctgaaggcggaattaacacccagctcaccagtctccaaatttgtccatgcagtatatggtacggactcaaagccagatagcccataatacctactccggtcatgttttgaaaaacctccagggcatatccaatcacataacacaaaataatatatttcgtcaattccggtattgcatacctgccgaatttccgttccattttatttaaaaaattcatttcatttcctcatttccggtttattcccgccctcaagaaattttctgatttcactttaaattaaaggaatgaaccctaaaacaggtctttctttgaaaaaataattgccacaatcagacttagtatcaaagacaacacaattacaatagcaaatccatacggactgtctgcaaatggcatcccgaatgattttacattcattccataggcactgaaaatcatagtcggaatggacattacaattgtaactgttgccaaaaatttcatgacaatatttaagttgtttgaaataacagacgcaaacgcatcggtcattccacttaaaattccactgtaaatatttgccatctcaatcgcctgcttgttctcgacaataacatcctcaagcaggtctgtatcgtcgggatattttttaatccggtctacctttaaaagcttttccagcaccacttcgttagaacgaagggaagtaataaagtagaccagtgatttttccagttcaagaagttctatcagctcctgatttctggtcgaagcatgcagtttctcttccacttcttcacttttcttatctatgatacgcagataatgcaggaacatgcttgcattattatacagaatctgtaaaataaaccgcgttttcatataagtataaaaattgcgtacacgcccgtccatgaattttccaagaaccgatgtatcttccagacaaactgtaaaaatcatttcatttgtgattataatagaaagaggaatggttccaaaccagtccttgtctcctctttcctctataatcggagtatccaccaaaatcaaggtataattttcttcaacttctatacgggagcgttcttcttcatccagaggtgcacgtaaatcatctacttctatctgaaaccgattacagatttcaaaaatttccgtagcagtcggatttgtcagggcaacccagcaaccttcacatgcttcctccatctgatgcatttttccatcaatggttttaaaaattcgaatcatggtatctcccttcgtctgccatgaatattattctgcgtaatcacatttatggaaaataatactgtttggagtttctaccttaagcggttttcctttcataatcaacagctttttctcataatcaattgaaaatgttgtgatagagtttgattcatgattgacaacagccagatgacgaccgtccgggaatacatcaaggtcttttggatattctccactgattggcagtacgaactgtctttcaatatgacctgtctcttcatctactttatacattgcaaccgtattttctccggctgtagaagtaaacagatattttccatcttcagaaagacacattccagaagttgcatcatgtgcctcatcttcatgggaagccaaagtgctttctgtctgaagcagttcaaatttcggatttttaccgcttccatcataactgtaaacctgaatttcattttttaattcatagtttacaaaggcaaactttccattcgggctgaatttaatcagtctcggaccagattctctgacacaacgaagaacgtcaaccaaatccagcttactggttctctctgtcggacgataaatcttaatctgatcaattccattatcaactgcacacagatattttccatccggagtcggacgcacacaactgacatgaggacggaagtttctttctgcaacactgccaagacctttatggaagacaccatccataacacttccaagtcgtccgtctctatgtgtgtgtactacggtaacttttccatcatggtagcctgcaacatacagatattttccttttgtatcggtggaaaggtgacagcctctcattccatcaataccaactttattaataaaggttaaatccccatccggctcgattgcaaatactgccacaccttcatcagcgatagagtacagatattttccgtttacagagatagccagatgggaagaattatttacaggaactacttttctctctgtcatagttccctcttccacatttacgtcatataaatgaattccaatactgcttccgtgagtataagttccaacataagcaacatacttttctttcattatagtaataccctcctgtctgttttttattcgttccgttgtccggtctaccgacattctaccacaaagtttttttttatacaatgcaatttcccccgattttacaaacatttatctcgcccttctattgacaggattttcggttctagtataatgaaatttaaaagcctggtaggaatcattccgtttctgccggcattttatttactatactttatttaaggagactgccatgaaaaaaacactggtggattttatccatatctcaaaaggatttggggaacagcttgttttagatgatttaaatctgtcggttcatgaaaatgaatttctcactctgcttggtccaagtggatgcggaaaaacaaccactcttcgtatcttaggaggatttgaatccccggacaagggacaggtcatttttgacggtcaggacattacgcatcttcccccaaataagcggaatttgaacaccgtattccagaaatacgctcttttttctcacatgagtgtatccgaaaatattgcttttggcttaaaaatttccggaaaatctgatgcctatattaaagataaaatccgatatgccctgaaacttgtaaatctggaaggatatgaaaacagacttccggattcattaagcggcggtcagcagcagagaattgcaattgcccgcgcaatcgtaaatgaaccacgtttactgctcttagatgaaccacttggtgctcttgacttaaaacttcgtcaggacatgcagtatgaactgattcgtttaaaaaatgaacttggtattaccttcatctacgtcactcacgatcaggaagaagccctcaccatgtccgatacgattgttgttatgaatcaaggttatattcaacagatgggttctccggaagatatctacaatgagccacaaaatgcttttgtagcagactttatcggagaaagtaatatcatcgaaggagttatgatacaagaccgcctggtacagattcttggtgcaaaatttgattgtgtcgataccggatttggacagaataaaccggtcgatgtagtcatccgtccagaggatgttgaccttgtagaaccggaaaaaggcacaattaccggtgtagtcacacatttaatttttaaaggtgtccactacgagatggaagtgcaggcaaatggatttgaatggcttgttcacagcacagatatgtttccggtcggacaaaaagtcggcattcatgtagacccgttcgatatccagattatgaataaaccggaatcggaagatgaggaggcgataggagttaatgaataagaaaaaattgcttgccggaccttatcttttctgggctctggcatttattctcatcccgcttgctatgattgtctactatggtcttactgatgcaaatggtcatctgacctttgaaaatcttctggctatcggaacggttgagaattttaaggcactctgtctttccctcctgctttctctcatcagcaccgccatctgtctgctccttgcctatcctctggcaatcattctttccaatatgaaagttggtcaaaatggatttattgtgctcatttttattatccctatgtggatgaattttcttctgcgcacactggcatggcagaccctgttggagaaaaacggagtcatcaatcaggtgttacactttttccatctgcccacactccagctaatcaatacgccttatgcgattgttctgggcatggtttacaactttttaccgtttatggttcttccgctttacaacgttctctccaaaattgacaaagatgtcatttctgccgcaagagacttaggggcaacagagctttatacgttccgtaaaattatctttcctttaagtattcccggtgttgtaagcggtattattatggtttttgttcctgcacttaccacctttgttatttctgatttacttggtggaagcaaaattttgttaatcggaaacgtcatcgaacaaaaattcaaacaaggaagcaactggaatgtcggaagtggtctttctctggtgctgatggtctttattttgatcagtatggtgattacaaccaaatatgataaaaatggagaaggaggcatgttctaatgaaaaaaacagcacgtaatatctaccttggattcattttatttttaatgtatgccccgattgcgactttggttgtactctcttttaactcatccaaatcccgttcaaaatggggtggatttacgctcaaatggtattcttccctgtttcaggacgacgccattatgagtgccctttataatacccttgcaattgcgtttctttctgccttaattgcaaccattatcggcacttgtgcctctcttggcatcaccgcaatgaaagcaaaatggcgcaccgttatcatgggaattaccaatattccggttttaaattccgatatcgtaaccggaatttccttaatgctgctttttattgcgtttcgttttactttaggcttttctacaatcctgattgcacacattacttttaatattccttatgcaatcttaagcgtcatgcccaaactaaaacagaccaataaaagcacttacgaagctgcccgcgacttaggtgcgggaccatttcagtcatttatgaaagtcgtatttccagatatcctcccgggtgtattgtccggatttttaatgacttttaccatgtcactcgatgattttatcatcacccactttacaaaaggtcccggagttgatacactttctacaaagatttattctgaagtacgaaaaggaatccgtccggaaatgtatgcactttccactcttttattcttatcggttatggtaattatgattttaatgaacacctcaccaaaagaaacagattctaaaaaggctggttcaacctcaaaagattttaaacgaaagcgaaaaattccatggcatcaggtaatccctgccggatttatcttattaatcgcagtaaccggattagttcatcatgtaagaacaaccggaagtgtctccgaagaacaggtaattgtttacaactggggagaatacatcgaccctgatgtgcttgacatctttgaagaagaaaccggaattcaggttatctatgaagaatacgaaaccaatgaaatcatgtatcctaaaattctttccggtgctattgcttatgatgtagtatgtccttcggattatatgattcaacgtatgcgtgaaaatggactgttaagcaaattaaaccttgataacattccaaatctgaaaaatattgaccctgcctatttaacccagagccaaagttttgaccctgataatgaatattccgttccatattgcgttggaacaatcggtattctctacaataaaaatatggtagatgagccagttgacagctggaatattttatgggatgaaaaatacaaggatcgcatcttaatgcaggattctgtacgtgatgcgtttgctgttgccttaaaacgtaaaggctattccttaaactcagtcgaagttgatgaactcattcaggcaaaagatgatttaattgcccagaaaccacttgtacaagcttatgtagtagaccaggttcgcgacaaaatgattggaaatgaagccgctctcggggttatttattccggtgaagcgctttatacacaaagagaaaacccagcacttgagtatgtcattccaaaagagggttccaatatatggattgactcctgggtgattccgtccaacgccaaaaataaagaaaatgctgaaaaatttattaatttcttatgccgacctgatatagctcttatgaactttgagtatatcacttatgcaactcctaatgcggctgcaagggctttaatcgaagatgaaagtatccgaaacagtgaaactctgttcccatccgataaagatttggcacgctgtgaaacattccgttttcttggagacgaggcagattcttattacaacgaactttggaataaagtaaaatcaaattaggagtgataccttgaaccgaacctttacttatcttattactcaaaaggattccccttgcacagtggaatcctatttaaaaaaacgaggttattctcatccgattttggttcagttaaaaaagacccaaaacggaattttagtcaatcaaaaatgggcttatgtcaaaacaattctaaatcccgatgataaacttgaaattcatctggaagagaccgcttcttctgaacatattgttccggttgagcttcccttctctattgtttatgaagatgaagatatccttgttgtaaataagccggcagatatgccgattcatccctcaattaataattatgaaaatactctggcaaatgcagttgcctactattataaaaaacagggagaaacttttattttccgctgtatcaaccgcttagaccgtgatacaaccggacttttaatcattgcaaagcacgctttaagtgcctcgattctttcaaaacagatgaaggcacgtgaaatccgccggacttatcttgcagtctgcaaaggtcagcttccggccgaagtcggcattatcaatgccccaattgccagaaaagcagattctgcgattgaacgctgtgttgatttttctaatggagaaagcgcagtaacccattatcgggtgcggtattaccagaatggctattcccttgtggaacttcatttagagactggacgcacccatcaaatccggattcatatgcagtatcttggaaatccacttccgggggattatctttactgtccggattactctaaaatctcacgcactgccttacattcctaccggcttgcattttgtcatccgattaccggaaagcgaatggatttttacgcaccgcttcccacggatatggcagcattttttcagtaaataaaaaagtactgcgtatttctttcaaatcacgaaatacacggtacttttttattgctctttattattttttctggctgctcatacagataagcctatgggggttctccaccaatttataatgcccgaattctcggcacttcatctacatgcagatattttccaattgtttttacaataatatcatggttgataaatggattctgatctgtcacgacaattgctccaatgactcccacttcctctacacgaatcggaaatcctccacccatgcaggaaaactctttttcatcaagtccaatatcttctaaggtttcttcattttgctttaattcgctgtataaaagcagactgcttttttccattatttttacggtattgaaggtccggtctgtaaaacggtcactgtttaatgtagtcgtatttccggcatacttaaataccgtgctgccattattctttcgaattgtaatcgaacaatccaatccacgttttttactctctgccaccagcataattcctaactgccatgcatcctcatttgtaaaatgattgaactgtaaaatctcttcctgcagacttaaaacattaattacttcatccattgtcatacgccattcctcctgtctgactttatgtgaaatactttttatatttaacggattctgtctggaaaacctacttttcgctgtactttgcggagtgttttatttgcataataactggctttttctccattttctttgataatagaatctaagtaagctttatctttttccagtctggcaacttcatcctgaagtggttttaacacacttactacagcttcaccgactgccattttcagttctccataacctcttccttcaaattctttcaccgcttcatccggtgtttttccgacacatgcgcagtagatatcaatcaggtttttcagtcccggctgctcctctctataagcaatatttgcctcggagtctgtcactgcacgtttacatttacggataattgtatccggatcatccatcagataaatacttccatttggattttcatcggatttagacatctttttagacggatcctgaagactcatgatttttgctccaacttttccaacataagcttccggaatagtaaatacatccccataaatattattaaaacgagtagcaatatctctggttaattccaaatgctgcatctggtcaattcctaccggaacaacatctgcctgatataacaaaatatcagcagccatcaagaccggataggtaaataaacctgcattgatgttatctgcatgttttgctgatttatctttaaactgcgtcatacgattgagctcgcccatataggtaaaacagttcaaaatccatgccagttctgcatgcccggatacatgggactgataatagatacaattctttttcgggtctaaccctgctgcaatgtaaagagtcagaagtgctcttgctctttttctaagtgtagctgggtcctgacgcaccgtaatagagtgcatatctacaacactgtagaaacattcatactcgtcacttaactttacccagttttttaatgccccaagataatttccaagagtcagatttccagttgcctgcataccactaaacaacacttttttatcattaatcatctttttgtcctccaagttttgctaaaataaattgtaacattgtgccactgtaaagtcaaatatacttgcacgaaaatttaattcgatttataataaattttgaaaaaacaaaccctgaaaggagaattagctacatggaaaaaattgcaagctttaccattgaccatataaaattacagcctggagtttatgtttccagaaaagatcacattggagacgaagtaattaccacttttgatttaagaatgacttccccaaacgaagaacctgttatgaatactgctgagatgcacacaattgaacatctcgctgctacttttcttcgcaaccataaagagtatggcacaaaaaccgtttactttggacctatgggatgccgtaccggattttatctgcttttagcaggtgactacgaatcccgcgatattgttgatttaatggtggaaatgtttactttcatccgtgactttaagggcgaagtgcctggggcttccgcaaaagactgtggaaactatcttgatatgaatctcggtatggcaaactatcttgctaaaaaatatctggatgaagtcttaatcgatatcaaaccggaacgtctggtttatccagaataattccaagttcaaatcagacaatataaaaatataaaaacaccaaaaagaggaagcaaagtttacttttctgcttcctcttccggtttataatcataatcttttaattctgttttctcttctgcttcacaaagatacacatcttccagatgacgttttaatacccgttttcctccggtatctccctctaattccagcaattcttctcggtatttctcatgaaaaattaccggatttccaatttgcccgttccatactactgctccgattcctttttcacttctttgaaagccttccaacagacgaagaatggtctcttgttttaaatgtggctggtctgccacaacaaagcagtaacattctccttttacattttctttatgaaccgcccgaattcctttttttatcgaggcagaaattccatgactgctgtctggattatccactgccaaaaatccatactcttctgctgattttcgaattcgttcatactgggataccacacacactcctgccacatgttctgaatgttgtctcacccagtccaacttttccattagaatttgatacattggtgttttttccatcgaataaatcagcttatttccaccaaatcgtcttgaaaaaccggatgccagcataatcagaaaaaacttctttttttccggcatttccaattttttctcataaatcaccggaacagacagcttttcttcaaatgtttgtgaatcctgctgattaaaaatcactccaatttttctttttgaatttgataaagaaccggttaatttttcaagataccctttttctaacagctttgccacaatttccggcgtcaacagtttttctctacaatccgcctgatttaaaatttcctgtgctttttccagtcggaaacagacttctgataatgggtgattaaatgcctgcatgctctctacaattaaaatatgagttgttatctgataaatcaccggctcatgttctgccggcactttaaagggataatgtttcgctccatctgcttcaataactactgcatcataactttctaacacttcttctaactgtgtttccaaaagccccgcaattttcttttcctgctccagttttcgccctgcaattacaacttttccgggtactcctgcctcttttatggtcttcgtatctgcatcaagaagacctgtccttccaagataaaatggatgctgaatatgcgtacttgttgttaccaatactttcattcccagacctgccagctcatctgccagctttaatacacaagtggtttttcctcctgctcccacaaaagaaaacactggtttttctggcagttcacccattgttttttttatttttttcaacagactcatagacagcctttctcataggcacagactaattctaatacgcttcctgccagacatctcgccttatctgaaatcagggcgcaatgtttctgcgattcttttcttgggtcaacatctgcactcttaaacccttttgtcactggaaaaccatctggtaaaattccacgaatcacacccgtaatttctgtttttacttctattacttctcctgtatctgtttgaacttctccaatacaggctttcgcttctacccagtctccaatatcaaactttttaaaaaacacaccctctgccggtgcatgaatgactcgctcttttccgtatccgccaatgactccgggaatccccgtattttcaattgcacttcctttgtctaaaattttcccaaggtaatgccctcttttggtttccactacataatccacatcttttcctgcttcaaatcctggaccaagtgcaatcgtaagaggtgccatttttcttgttgttccaagattttttttcgcaataattgcatcaattaaaatttccggttttaatagaggaatactttctcctttcgggtcaaccaaaagcaccggatgcagtggttttgcctctttaagtgcctcttttacactattcacgcaaacgcaggttatcccttctacacatgcactgccattttctacagcttccgaaaatgcaaccagacgccggatagctgacggcttatctgtctctaaaacaatcacagaatatccgctttttgaaagacggtgaatcactcctgttgccaaatctccgccgcctcttactacgattggcttcattatcctatcctcctgttttttcatttctttaaggacggatgaccttcgtagctcccgccattttctgtgcaatttcatacatatttgtcacatttccaactacaagcttggactgcatttgataatgatttaagcaagttccacaggctaagatttccacaccatttttttctaatgtttttaaatcttccagactttctgaaccttcacatgcgaggaaaattccgctgttatacattaaaactgtctttggaagctcctctaactgggttaaggcatagatatatcctttgattaaaatttttccaagtacttcatcgccctctcccatcttatttgagcacagtaccaccactgttcccttccctgccggttttacttcctgtggctgttcttcttccgtttttgctgacgagagttctgtcttatcagtcgggacaatatgtacctcatatttcttttcctctaatctggtataggcaaattcacaattttgagaagacgcaaactttctcagattatctacagcaatctgattgtcaaccagaatctgaaatccttctttctttccttcttctaattctttttttgctgccacaaccggtcctgggcatgcaactccaagtgcatcaattactttcatctctaatccctcctaaatattctatttaaagcattacatggtaaatttggtcaaattctatcttcttatttttcattttcgtttctaagactttttctttttccggtaaagtacaccaacataatccacagcctgccgatactacacccggcagaggaatcagacgtcccggaagttcttctttttgacagaattcctccattgcaattgcctgcgtagttgtatgaaaggtaatcaccagcttcatcgtcttttttctcatgttttcatccccttacgcctttcatctttattctaatagaaagcaacaaaaaaaacaagaatagaaaccttctatccttgttttttgtcctacacattatcttgctttttttaatgcagcacgaagcgctgttcccacaatcattgctactacaattttaactaaatctcctggaatatacggaatcactcctgccgcaagaccagctgctgcactcatatgtgcctggaagcacaaccatgctgttccaaatgcatagcagactactgttcctaataccagtccgactgcttccattactttattccccggaaacagtttcatcaaaagccctgcaattaaggtcaggaaaataaatccaatcaaatatccgccagtcggacctgccagttttccaaatccaccggaaaatccagaaaataccggaacaccgaccattccgattaataagtaaaccagataactaattgttgctccattcagacccaacacataaagacttaaataaattgctaagttggtaaaactgattggaaccgggctaaatggaagcggaattgataatggacctaaaatacaggttaccgctgtcatcagtgcaataaatgtcatctgtctggttgacattttctttgttgtatgttctttgttcactgttgctgtattcatgtttttttcctctcttctctttgtttgacttccttagtatatagaattccgtctctaatgtcaaccttttttatttattattagttaacatttattttaacaagaaaacatggataacaattccatgctttctttccagattacttttttcttcttaggtcaattttttgttttcatttccgaagattaagataatccaaaattaactctaccgtttggtcgattccaagcacccctgtatcaatgcacaagtcataatgctctgcttttccccaggtttctccggtataatacttatggaaatccgccctctcctgctcgattttttcaattcttgcctttgcttttgccggactgactccatctcttttggtcaccatgttcactttatccgatttttgtgcatacagaaaaatactcgtacagtctgcatcgtctttgaacacataatttccgcatcttccaaccaaaacacaggattgattttcacatagcttacgaatcctgtcaaaggcacgttttcctctgcatccttcttcctgattcatcgcaatcgcataaagcaggctgttaattggctgttcttcataaaaacagcttacttcttcatatcctgatttttcctttgcaagtttcatcaattcttcttttccataaaacggtattgcaagacgtttcgcaagttttttcccaatttcttttccaccgcttccatactgtctgccaatggtaataattaatctactcatgccttacacactccttttctacataaacccagcaaatacacttgctcctactactgtaagaagtcctgctactgcaattgcaagactgctcatcgctccttcaaccggtcccatttccatagctcttgctgttccgattgcatgagaagctgcgccaagtgccaatccttttgcaaccggctcttcaatgtggaacaccttacagaccgtctcaccgatcatatttccaaggattcctgtaacaatgataacagctacggtaatcgttacaattccaccaagttcttctgatatccccattccaattgctgttgtaatggattttggaagcatggttacatactgttcatgagaaagtccaaataattttgcaagtattaatactccaacaagacttgcaagtacccctgaaatcaatcctgcggcaactgcctttaagttcttctttaataactctaactgctcgtacaacggcactgcaaggcagacagtagccggtgttaaaagataactgatgtattttccactctgattataagattcataactgatatttccaactaccagtactgcaataacacaaattacaccgattaagagcggattaaacactgccatcttaaattttttctttaaaatcaatccgatttcataacctacaagacttaagactgctcctccaaataaagaaacatctaaaaattctttcatttcctcttcccctttctgataattccctgtgtcacaagtccggttaccaccataacaaatactgttgtcacaacagtaataattccaagcggaataatcaccggctgtaagattccccaggaatcaatcagacctgctgctgccggaatgaacataaccggcataatctctatcaaaaaagcagatgcctcctttacctgatgcagttttaatactcctgtcataagtgctgccagcataaacaccagtccatatacacttgccggaatcggaagcggtaacacctgatgaagcacttctcctaaaaaggaaaaggctaaaatgaccataaattgctttaagtacttcataatctttttttcctgttctcctctctttttgtgtttaccaatttaattttcgtctttaccaattatactcttgcgccaaaaaaagtcaatgcaggaatgtaaaacattcttaaaatctctgcattgacctcttgttttaaagttctaaaaatccttttataattacacagctttttactggcgaatataaattccctgttcttcaatgaaatcttccaaatcctgaagagcatcctgcgcccaggtttctgataaagataagtctgccggttttgggaaaaacatcgtttctgccatttcttttccggtttttgtcttaaaaattttctctactgatttttgaatagtatcagcagaatttccgttttcaaaataattgaccagaaaatccgcttctaccaaaatctgataatccatcccatctatatttgtatacgtatgatgatgtcccaccagatacgaaaccctttcaatcacagcctcctcaaacccaatcacacgcatcatcttctctgcctcagccggtccttcctgctcctgaaattttccatcgctctttccatattttgcttctgccggcttgattccaatgtcatgcactaaagctgcgcactctaaaataaactggatttcttcctctaatttttctgcttttcctatcgcctgtgcaaagctgtgtacttttacaaaatgctggattcttgccgggtctcctgcatcataagccatcatttcccgatacagtgtttcttttaatttttcttttgcgtcttgattcatacgccatccaacctttcccttattatcgtaaagaaaatcaaaaaaagcagacaaaaaccttcaaaaagacttctttgtctgctttatttttccattatatcactcttttttgtatgtgtctattgcttttgtttccttaaaattactgtgtcaaaccctgcaattgtcccatcataactgcccagccatacctcaaatccatctttcggaaattctatttctatccggttacaattgaaattttgcacaatccgataaactgctttttcattttcccggctggtgacttccacaccataagggatttctttcattagaacagtaatgttgctgtttttcacaagctttttataaaaatcatcataaaaatcctgttcaaaatctgcacagatttcgtaacattcgcctgcaaaaattcctgtcaagcgaatatctgcaatatgctttgattaaatccccttaaaggaaaatttaaattcttttttctgacttacatccagcagatattccggatgcgttttggcaccccagctgtcatctccgccaacacccatctgctgcatagaagctcttactactgtataatgtactttcggcagttcaaacggatgtgccgcattttcaatttcatgcggagtataaggaagtgcggaaaattccattttatcactcttaaagagcatacctctgccctttctatccgttacttttgcccagcgtacccctgttttatttccacattcctgcggaactaaatattttgccatattttcttctactttattttgataaataccaagttttgcacctttatttctgtctacataagtctcttccggtcccattccataccaggttacctgattatagtctgcatcgaatttgaaaatcacaccaaattctggcatatctcctaagtcttttaccggttcataagaaagtaccgtctcgattgttccatctgcaaatacttcataagaaagttcacattctgcctgtggagtcgtcggcaggcaataagtaaaacttacaattgcagaatgtgcttttacttccagctttggttcatacattccaccctctggttttttatgcgataaatacaggcttgccagtttccactgtccataacgcattggcatcagatttccatagtcattatcggttggcgctctccagaaatttggttttgggatggcttttatcatttcttttccaccatacacataggataccaatccgccatttaagtatgagaacatcactttaaaaccgtccccatggatcccaatattatgtgtactcttaacaacctctaattctccctttggaatctgtgcggctctctcaaccttatacaccccctgtccaaaggcaacttcatgaccacgttttgcccagactgtatcctcttttaacagaaatgctactgttattacatactctcctgacagagtctgaacttcaaacggaagcggatatgtttttttactaagtggtgctacatctgtctcaagttgttttcttgcaagttcttttccatctttttcaagcactgccacacagtcaaactgatttgtattcacaaataaatttttattttcaactgtaacctgtgttttttctacgacagcagtaatattctggtaattgaactttacttcctgcatctttggagatggctctctgtctcctccataagcaattccatttccactaaaattataatcacacggacggtcatcaaagtctccgccatacgcctgaaactcttttccgtaacggtcttttttataaatagactggtcaatataatcccagataaatccaccctgatataacggctctgtatctgttaaatccgtatatttatgcattgcaccacaggaatttcccatcgcatgtgtatactcacagcagataaatggcttgcttctatcctttttcagaaattccttgatactttccacagacggatacatctgactttccatgtcactggtatcattatatcttctgtcattaaatacaccttcataatgtaccagacgggtcgggtcttccttacggtaaaactctgacatttcataaatcacacttccgccaaaggactcatttccacaagaccagataagaattgccggatggtttttatctctttgatacatggaattgacacggtctaacagcatgcctttccattcttctttatcacacggaacaacattggtataatccggatgctcttttcccgcctgagtgtcccagcttccatgtgtttccatattattttcagcaatcatataaattccgtattcatcacataactcataaatatcagaaccatccggataatggcaggtacgaattgcattgatattattctgtttcatcgtcaccagatctttgattaattcttcccttgaaacatgacgtcctgttacagaactaaattcatgacgattgactcctttaaagacaattcgtttgccatttaaggtcataatattgcctttcatctcaaatttgcggaatcccacgcggtatggaatcacttccataagcttctgattttcatcaaacacttgaatgagtaaatcatataattccggtgcttctgcactccataatttaggctgttctaccaaaactacaaacctgctttcactttcaagtgccccttctatatttacaattacttctccgtctttgctcagacaaatcttaacgtttccgtttccaactccttttaaaaccagttccaaatctgcttttgtaaaagtttcatccagtaaagtgcgcactctcatgtcacggacatgtacttctggaatcgtatacagatatacatccctgtaaattccggaaaaacggaagaaatcctgatcctcgcaccagctgctgcttgtaaatttaaatacctgtactgcaagcttgttttccccatctttaagagaatccgttaactcaaactctgacggtgtaaagctgtcttcgctatagcccacaaagactccatttaaccagactgcaatcccactttctgctccctggaaagaaataaaaactcgttttcctttcatattttccggtacttcaaaatattttatataacttgctaccggattaaaatgagttggaatttctcctagtttgacttcttcccagccttcccaagggtactgtacatttgcatactgaggctctccatatccctccatctgaatatgtgccggtacacggatatcatcccagtttttacaattatattctgttttttcaaatccttttatagtgctctcataattttttgcataatgaaatttccaaagaccatttaaatcatatttataattttcttctttttgcaacatcgcttccatggatgcataatatttatggtcggaatgtgcctctactctgttttcctggaaatactctggatcttttactttgccataatcaaaaccgctcatactatatcctcctaaaacctgatttttatcatactttctcagtatatcatatttcctttgacttcgttgattttctcaataaaatctcataatccatcatacttttttgagcgtatttttctccctgtgaactactcggcaactgagttaccagagcatctgaaatctggcgggataccgccttttttcagggtgcgtccatgacaccaatactgcttgcctttcggctatgcagctacttttattatatctggtttttttagtccggttacggacagttctttctgttttccggatacggaaagatatttccgcaggatattaaatgcgcctaccgcatctgcattgtatcttactccgtcagttacatacatgccccgttcttttcggtttgatgcttctgcatatctttttgatacttctggtgataacgggctgcactggctggtatagctttcttcttgttttatcaatgggatcccataccgtttcagcttatattccagcatgatatacaacttattatacggcaggctgtgaaacttctggtttgtcttgtgtcccatatctttttctttccggatatttcgaatgtctcccacaaccacacagcggatctcttcttttctgcagtattctgcgatccatctggtcactttgtgaagataatccttcactgcattctgctttttcctgtaaagtctctggatatgtttcgatgattttggatattttattcctctttccgattgttgtgtataccatactgactgcactctggcgatctctttatgaaaatatctttccaaagagagatattttcttcccaggataaaagcccggccatttccagaatcataacaggtcatcagattatgaatccccagatctatagataagtaatgtccattctgggaaagctgttccggctcttcactctcataaataacaataagggcgcattttccattctccggcggatagatccgcaattgttttatatggtccatgctcctgaaaatcttattttcaagatatagaaatttctcatggatctcgtatgtttcttccatatagcttttcagattctttggcagagacagtcgcagctggtctgaacctttctcatgctggatccccatctgcatatatgtaaccgggatatttccctgtttaaaacggggcggatttggttctttgatccctccagtcttttttaggacataaaaggatttccatgctttgtccagctgcttgcagatctcctgcgctgtctgtgacagaagctgtttataccacagatttcctttatgtgcttttttctgataataccagtcaggatacttttccagccccagctctttataatgacgccgttcgtagttgcagatattccagagtttggaggctacataacacatatgccctatgatattggaatattcctgactgatctttatggatgttttatgtgacagcagcattcctcttcctcctttaagcactgcgcagatagggcttcacactccatcttgaatcaatacgatttgctctgatgttcaatataacggcggatattttcttcagatacagatccgatcgtttccacataataagaatggttccacaaccctcctttccatagctggttttttatttccggaaaacgttcgaacagttttctgccagtgatccctttcaaatacttaacgattgccgttatagaaagttttggtggagctgatacaaagcagtggacatggtcgccttcaccacattcaaataaatgaacagtaaagcccttgtcctcagcaatctgctgcaccagttcctgaaggtattcctcaatttctggttttaatatcttccgtcggtatttcactgaccacaccatatggtagttaatattacacacgcaagttctataatgtattaggttttctttcatgcatatagtatatcatattgaattgtaatgcgcaacaattgtccgaacatattttcgtttttattatataccggttacggcatttattttttatatttatattttaacagaggatgaggattattatactgtttgcatcgtgcagatatgcacactcctgcgctttcatctcggtaattgaattgccgaggattcccgcttattgtcctaaacaatgaatcatctgtgttcccattcggattcccacctgtcttgccggaacactgaccgctgtaatcgacggtgaaaaacagtttaaattagaactgttatataacgaagcaattgcaatatcttttggcactcggtaacctcctgcctgtaatcgtgacatcatccatgtactgattacatcatcaccacatataatacactgtactttttttgcaatcatatcactgataattgtatccagaaaatcaattttcagagcaccggtataataaagctgttccctttcagggattccgttttttattaatgctttataaaatccattgcgtctgctgcgatttacgttaaaagataagtcttctaccacaagcgcaaaccgctcaaatccctgtcccactaaaattgagactaaatattgctttcatagatggaatatacatcctgaaaaagattccaaattcacttaatccatcaattcgtgctgcttcaataatgtccacaggaaaggctttcgcattggtacgagacatcataatcagaagcggagttgccagtgatggaagcataaatccaactgctgagtttaataacccaaatttggaatacatccgaaacagcagaaccttcctcttttttgcttgagccacaacctgccagcaggcttactgccattgttgagaccaaaatgcacgaaattaactttttcttcataataagctcctcctcttttgcgcaatttttatcgctctattttgcacaaaaaaaagaacccttattgcagggttctttttcgaacattaaaatcctaatttctttttaaattctttggtcagttttacacttccaatactttccacacttccagtcattttcagattccaattctcatcaatctgaatccacagctttccacccggcatgtgcaccatcacatcctgaccaacccaacctttcttatatgcaacagctgcggcggcacaactgcaggttccggacgccagaatataaccggctcctctttcaaagatttcaatattaagattatttttatcttctacttgaagcagcataacattaattccatttttaaacatcttagattctgcaatcttttttccaagtttacagaccttttcacggtcgattgtctctgccggaatcacacaatgcggatttccgattgaagcaataaatgcagaatatcgttcttccccaagcgttaccgttttttcctctccaaaactcattttccccatgtctgcctgaatccggcttccatcatcgtttaaaaaacgaacctttacgcttccacctgcagtctccagcgtcagcctctcacttaatgtataaccagcatcttttaaatatcttgcaaaaatccgaattccatttccagcccgctctgcttcacttccatctgaattaaagacacgcactctgatttttttctcttcatccagataaggtcctgctaaaattccatctgctccgactccaaaattccggtcacagattttttttatctgttctctggtcagtacttcttcattttttataacatcatacaccaaataatcatttccgataccctgatattttacaaattccattttattttcccccaattttctattcttctaatttcagaagtctatctattttctagtgtatcagacatctttatgttataatataagtattatgtcaaaaatgttgcaaaaaatgttcaatttatcagaagaaccgaaaggatttaacacttatggaatcagaaacattcaataaagccggatatttaaaagacaatttccgcttatttcatttaacagatacaaactctcttccgatttcctatcattaccatgatttttataaagtatttcttttattaagaggtgatgtcacttaccatatcgaaggaaaaacttatgacttaaaaccttatgatttggttttagtaaatgccggagaaattcataaaccggttattaacagcactttttatgaacgaatgattctatatatttccccggattttttagaacgttataaagaatccggggatttgctggattcctgttttaccaatgcagaaaataatcattctcacgtactccgtgtcgaactatttgccaaaagccgtctttatgaaacactggttgaactggaaggttctcttgcacaggatgactttgcttccggtctataccaaaacacactatttcttcaatttttgatattattaaatcgtgcttccatggattcttattcaagtgcctacattccaaacagctattgtaactccaagattctgccgattttagaatacattgcagaacatcttgtggaagatttaagtattgatacactctcttccaaattttatatgagccgttattacctcatgcatttatttaaaaaagaaaccggatacagcgttgccaattatatttccacaaagcgtctgctccatgcccgcgctttaattcaaagcggaacctctgtcacagaagcgtgctttgcaagtggatttaaaaattattctactttttcaagggcatataaaaagctctttctgatatctgcacgtgaacaccgctaatacagcataaatcaggcctctataccgacgctgtaccagttctgtgtcggtaactgtctgcacctttttcgtactttcatcatatagtaaagaaatgttttttctgactggaacaaacatgaataaaaaaacattcgattttaccatcatcggaggagatatgcgtcaggtctgccttgcaaaattactcgctttaaagggatactgcatctgccactatggtctctgcgaaccattaaaagcgccctgcatccagcctttggattctcttttagaagcagtctcctcttcttctgtttgtattgcaccaattccgttttccaaacttctcaataaaactccttatcttgaatttgctgacctgctttctgatggacacaccctgtttgccggctgtatcccaaagccttttttagaactcactcaaggaaaaaatatctctgcttttgactttatggcttcatctgaatttgcttactggaatgcaaaagcaaccgcagaatccactcttgcagctgccattctcttaagtccccgcacactttttgaaagccgttgtcttatcttaggatatggaaaatgcgccaaagctctcgcccgactcctttctatgcagacaccctatctaagtgttgctgcaagaaaccctgttcagcttgccgaagcttctttgacgggcgcacagaccatttccttagaacagcttttcgattgtgaattatcttcttttgattttatttttaataccatccctgcaccaatcttaacaagtgcccttttagaacagatttctccttctgccttattgcttgaccttgcatctgcccctggtggatttaacctcgaagaagcaaaagcaagggggcgaaatgcacatctgctcttaggactccctggaaaatacgcacctctttcctctgccgaaaaaatgatgtctttcatttttcagcacatcaaaatttcatcctaaataaaaaaggagaggttctttcttatgtcattatctggaaaaaaaataggcattgcctttaccggttctttttgcacctacgcccgaatttttgaagaacttgaagcactccaaaaagagggagctgtcatacagacgattttttctgactctgcacaaagtatcgacagccgttttggaacggctgaaagtttcttaaaaagagcagaagaaattacaggtatccctccaattcttaccatcaaagacgccgaaccaatcggtcccaaaagcctgcttgacctgcttgtcatctttccatgcaccggaaatacacttgcaaaacttgcaaacggaatcaccgatactccggttttaatggcagcaaaagctcatcttagaaatgataaaccactcttattatcagtctccacaaacgatgcccttggtttgaatatgaaaaatatcgggcttttaattaacgcaaaaaatattttctttattccatttggacaggacaatccagtcaaaaaaccaacttctctgatttcacatccagaacttctgattccatctattgaatcagccttgaacaaacaacagattcagcctttaatcaaagcctggtaatcaactcaccacttatagaattggaaaggagtatctctatgtgtggaattgccggattttgtaatccaagaaacgattttatgcaatctcaaaacaaatggatttctattcttgaagccatgaaccacacccttaaacgacgtggtccggatgatgagggaacgtatctttcctctcactgtggtctctctcatgtgcgacttgaaattattgacttattaaccgggcatcagcctatgataaaacaatgcgcctccggaaattattcgattgtctttaatggcgaaatttataacatgaaacctttgcgggaagaactgaaaaaagctggaactgtttttatcactaacagtgacaccgaagtaattttaaatggttttatgctttatcgggaagactttatcaaaaaattaaacggtatctttgcaattgcaatttatcatgcagaagaaaaacgactctggcttttccgcgaccgtatagggattaaaccgttattttttacgataacggataatacgcttgtttttgcatcagaaatcaaaggactctttatctatccgggaatcaatcctgtcgttgataaaaacggtctttgcgaaatctttgcccttggtcctgcacgtacttgtggaaacggtgtttttcaaaatatctttgaactgcttccaggtgaatttttaactttttccatagacggattaaacagacagttttattggaaattagaaagccgtccacacgaagattcttttttggaaaccatcgaaaaaacggcatggctgattgaagattctgtaaaaatgcagatgctttctgacattccaatctgtacttttttatccggcggcttggacagtagtctggttactgctatttgcgcaaaagaattgcaaaaacagaaccgccgattaaatacgttttcttttgactttaaagataatgcgaaatattttcagtccaactcttttcaaccaagtcaggatactccttgggcgaaaaaaacgagccaatatcttaataccgctcatcaccttttagaatgtgataacacagcccagtttgagtgtctgttccgtgctgtagatgctgccgacctgccatgtatggcggatgtggaatcttctctgttatatttttgttccaaagtaaccgcctataataaagtcacgttaaccggagaatgtgcggacgaaattttcggcggttatccatggtttcatcaggaaaaagcatttcgtactcctgctttcccgtggtcctctgattttgctcctcgaaaacttctcttgtccgctgatgttcttgccacacttccaatagaagaatactctgcctctgcttatgaagcaaccattgccgagactccacgccttttatcggattccccaacagaaaaacgcagacgagaaatttcttatctcaatctgcgctggtttatgatgacacttttaaatcgtatggaccgcaccagtatgtattccggcttagaagcgcgcgttccgcttgctgattaccgcattgtcgaatatgtttttaatgttccatggtccatgaaatgtcccaatggaatcgtgaaaggtctgcttcgatatgccggttctgaatttcttcccgaagaaattttgtggcggaaaaaaagcccttatccgaaaacttatgaccctgcttatgaaaccctcctcgctgaccgtctaaaagaagtgcttgcttctccaaatgcaccaatccgtaccttactggatacaaaaaaagttcatcaatttttagaaacaccatccgattataccagaccatggtatggtcagctcatggccggaccgcagatgcttgcttatcttttgcaggttaattactggctggagcactataagattaaactggtgtgaacaaaaacactttaccctatccgtattttcctaacaggactcttgttttacttcacagactgtcagacagtcgtcctttaccctgaagcggatttccattcctgcaaacgggaatccataaatccgctcggggtcttgttgataagccggtctgggatcttgttctaatactgcataaagcgccggtcttttttcttctggcacaagtctttctaactcttctggaatatcaacctttatcctgtcattttgatgcacacttgcaaaactaccttctgcttccggatgacaatccgaatacggaatataaggtttgatatcaaaaattggtgttccattcatcaaatctgcaccctttacataaagaatcggtctttctttttcatcaaattctatcttctctaaccgaacacaggataatcccattccatttggacgaaatggagagcgggttgaaaatactccttttctcgtatttccgcctaatttcggtggtctgaccgtcaaggaatagttttcccttctattttcggaaaatccccagataagccagatatgagaaaattcttcgagtccttttacagcttctttcgtgccatattccggttcaaataaaatctttccttccaattcttcgaccagaccgctctgtctgggaattccaaacttggaagaaaaatccgtaacaatgtgtgcaattgcctgaatttcatactgttctttcatcttatctcccctcctcgtccagctttccaaatgcaccattcggtatttccggataatgtttcaataattcttccactgccattctatactctttaagattttggcaacgtttgattttggtgttccagatgtccatctttggaaatgaataccgaagatagcaccagatttcctttaatttaaacaaggctttctcttcattgactgcattttcggtgaaatcctgataaagacgctccaaaaatgccccccaaacttcaagtgacggcaattcttgtccatgaattacggaaagcagacctggatttgcaagtacacctcttccgagcatcacgccatctattttcggaaatcgctttaccacgtcttcataatcctctttggtaaaaatatctccattatagattaacggtttttcattcttttgatatacacctgcaaacgcatcgaatcgtggactccctttataataatcagtctgaactctcggatgaacaattaattcctcataaggataattagaaaaaagttcaaatagttcatctatctcttcctcatgataacgaccaagccttgtcttaattgaaatttcgattggacatttatcaaaaatctcatctaaaaactgctttaatttttctttcttttctaaaaatcccgaacctcttccaccatttaccaccggtcttgacggacagcccagatttaaattcacttcttggtatccatattccattagtccttttacggttcttaaaaaatcttcgctctgattcgtcaatatctgtggaaccagatacaaattttgattattttccggaagaatatcccgtttttctctataattaaacaggcgccccttatttggctttgcagaaataaaaggtgcaaaatatttatccatcggtaagaaaaatgcatgataagcatttctgtaaattgcctctgtgacctcctctaacggagccatataatacttcattcttttagtttcctctcacttttctcttcaagtcgaacgcagacattatatcagagctgtccgaaaaagtatagtttctactcttctttttctattatttaaaattttttcaaaaaaatgcttgcttttttattacttctatgctattataaatctcggttgtaacactaataaaacttaaaaatctggctccatggtcaagcggttaagacaccgccctttcacggcggtaacaggggttcaaatccccttggagtcattaaggcgccatagccaagtggtaaggcaaaggtctgcaacacctctatcaccagttcaaatctggttggcgcctcttattcctccttagctcagtcggtagagcatgcggctgttaaccgcagtgtcgttggttcgagtccaacagggggagttttttattgcccagaaatgcgcatcgatgaaataagaattcatcgatgcgttttttatttgaaaaatccattctttaatcactttaagtcctaacgcacacagattgcatcttctcttacttccacaatctcagctacccatgctgcgtgtggaatcgtcagatattctgccatcgctggttctatagtatccccatcaatggtctgtctcccacagataatcaaatctgcgtcgccaatcacctggattccctgtgcaagcgcctaagaagttgccaagacatctgcccctgcaaattttcggtcagaaagaatcactgcgtcatctgccccatctcagctttaacttcttctatacttcttcataagtttgagttacaaaaaaagtcctaaaacaaaatgtttcaggactttttatttagaggcgccaaccagattcgaactggtgatagaggtgttgcagacctttgccttaccacttggctatggcgccttagtgactccaaggggatttgaacccctgttaccgccgtgaaagggcggtgtcttaaccgcttgaccatggagccaaatattcaattgttatcgtaccttcaaaactacatatacaaaaccgaaaccatgcagacacttgccgctccgctgatttctcagcttctggtcaagctctcgaccgattagtagcagtcagctccatacattgctgcacttccacctctgccctatctacctcgtcgtcttcaaggggtcttacttcctaagaatgggatatctcatcttgaggggggcttcacgcttagatgccttcagcgtttatcccttccaggcttggctactctgccatgcagttggcactacaacagatacaccagcggcctgtccatcccggtcctctcgtactaaggacagctcctctcaaatatcctacgcccacgccggatagggaccgaactgtctcacgacgttctgaacccagctcgcgtaccgctttaatgggcgaacagcccaacccttgggacctactacagccccaggatgcgatgagccgacatcgaggtgccaaaccactccgtcgatgtgaactcttgggagtgataagcctgttatccccagggtagcttttatccgttgagcgatggcattcccacttaataccaccggatcactaagccctactttcgtacctgctccacccgtcggtgtcgcagtcaagctcccttctgcctttgcactcttcgaatggtttccgtccattctgagggaacctttgggcgcctccgataccctttcggaggcgaccgccccagtcaaactccccgcctggcattgtcccaccgccgggtcacggcggctggttagaaacccaatactgcaagggtggtatcccaacatcgactccgtagcaactggcgtcactacctctcagtctcccacctatcctgtacatgcaataccgaatcccagtaccaaactggagtaaagctccatggggtctttccgtcctggcgcaggtaaccagcatcttcactggtacttcaatttcaccggatgcattgccgagacagcgctcaaatcattacgcctttcgtgcgggtcggaacttacccgacaaggaatttcgctaccttaggaccgttatagttacggccgccgtttactggggcttaaattcaatgcttcgtttcctgacatctcctcttaaccttccagcaccgggcaggcgtcagcccatatacctcacctttcggtttcgcatagacctgtgtttttgctaaacagttgcttgagcctattctctgcggcccgcttttacacgggcaccccttctcccgaagttacggggtcattttgccgagttccttggcaatgcttcttccgtcggccttaggattctctcctcatccacctgtgtcggtttacggtacgggtacgttacaaacaatagcggcttttcttgacgcatggctcacacacttccctactctagttcggtccgcatcacgcctttggattgtcacacggtttttcctatgtgactcctccttcgcttgccccgggattccattcccgggttgtgctttccacacgtgtccccacagttctgttctaacgcagtacaggaatctcaacctgttgtccatcggctacgtctttcgacctcgccttaggtcccgacttacccagggcagatcagctttaccctggaaaccttagatattcggccataaggattctcaccttattctcgctactcattccggcattctctcttcaatacagtccacagctcctttcggtactgcttcttcccgtattcaatgctcctctaccaatgtattactacattcctcagcttcggtgtcgtgttttagccccggacattttcggcgcaggacctctcgaccagtgagctattacgcactctttgaatgtatggctgcttctgagccaacatcctggttgtcttcgaaatcccacatccttttccacttaacacgtactttgggaccttagctggaggtctgggctctttcccttttgactatccaacttatctcgtatagtctgactcccgataatcaattccatggcattcggagtttgatattcttcggtaggctttgacgccccctaggaaattcagtgctctacctccatgtatctctatcgaggctagccctaaagctatttcgaggagaaccagctatctccgggttcgattggaatttctcccctatccacacctcatccccacccttttcaacggatgtgggttcggtcctccactgcctcttacggcagcttcaacctggacatggatagatcacccggtttcgggtctgcacatactgactctggccctattcagacttggtttccctacggctccacgcctctagcgcttaaccttgccagcatgcacaactcgccggaccgttctacaaaaagtacgcggttccgcatgtaaagcggttccacagcttgtaaacacagggtttcaggttctctttcactcccctcccggggtccttttcacctttccttcacagtactatgctctatcggtcactaaggagtatttagccttacggggtggtccccgttccttcccacaaggtttctcgtgtctcgtggtactctggatcctgtcttgtcctctttcctttcccatacggggctttcaccctctctggctggctttcccaaaaccattctggtagaatcaaggaatcaattatacagtccgaaccccagcatgcacgcacactggtttgggctctttcccgttcgctcgccgctacttaggaaatcgagttttctttcttctcctcggggtacttagatgtttcagttcccccggttcccctccatacgttatggattggcgtatggatacatgaggtcttctcatgtgggtttccccattcagatatctccggctcattggatatttgctcctccccgaagcttttcgcagcttatcacgtctttcatcggctcttagtgccaaggcatccaccctgcgctcttttttgcttggccattcagatcttatagcgttaacatctgacggctggtgttgcttggtttgtttctatttcttcgctgtatttctacagcgcctcgtttcgtctctatcttacgttttacgtattttagatgtttcgtatatgcagttttcaaggtacgactacggcagtaaaactttcgttttcttaccgagtggagataaagagattcgaactctcgaccccctgcttgcaaggcaggtgctctcccaactgagctatatccccatatttatttttttcctctgggtattacccagtgggcttaagtggactcgaaccaccgacctcacgcttatcaggcgtgcgctctaaccagctgagctataagccctcttttgtaatccggcagccacctgctttcccatgccgtctccagcatagtatcatcggccgcttaagtcttaaccatcgtgttcgggatgggaacgggtgtctcccctaagcgcatcgccaccggaaaggttttgttattaaattttagaagttttccttccttaataactcaacagtgaaacacttcttaactacttcttcttccttagaaaggaggtgatccagccgcaccttccgatacggctaccttgttacgacttcaccccagttatcaatcccgccttcggcagctccctccctaaggttgggtcactgacttcgggcgttactgactcccatggtgtgacgggcggtgtgtacaagacccgggaacgtattcaccgcgacattctgattcgcgattactagcgattccagcttcgtgcagtcgagttgcagactgcagtccgaactgggacgttatttttgggatttgctccccctcgcgggctcgcttccctttgtttacgccattgtagcacgtgtgtagcccaaatcataaggggcatgatgatttgacgtcgtccccgccttcctccaggttatccctggcagtctccacagagtgcccagcttcacctgctggctactgaggataggggttgcgctcgttgcgggacttaacccaacatctcacgacacgagctgacgacaaccatgcaccacctgtcttctctgtcccgaaggaaaggttccattacgaaccggtcagatcgatgtcaagacttggtaaggttcttcgcgttgcttcgaattaaaccacatgctccaccgcttgtgcgggtccccgtcaattcctttgagtttcattcttgcgaacgtactccccaggtggaatacttattgcgtttgctgcggcaccgaagagctttgctccccaacacctagtattcatcgtttacggcgtggactaccagggtatctaatcctgtttgctccccacgctttcgagcctcaacgtcagttaccgtccagtaagccgccttcgccactggtgttcctcctaatatctacgcatttcaccgctacactaggaattccgcttacctctccggcactcaagaaaaacagtttccaatgcagtcctggggttaagccccagcctttcacatcagacttgctcttccgtctacgctccctttacacccagtaaatccggataacgcttgccccctacgtattaccgcggctgctggcacgtagttagccggggcttcttagtcaggtaccgtcattttcttccctgctgatagaagtttacataccgagatacttcttccttcacgcggcgtcgctgcatcagggtttcccccattgtgcaatattccccactgctgcctcccgtaggagtctgggccgtgtctcagtcccaatgtggccgttcaccctctcaggccggctactgatcgtcgccttggtgggccgttacccctccaactagctaatcagacgcgggtccatctcataccaccggagtttttcacaccgtatcatgcgatactgtgcgcttatgcggtattagcagccgtttccaactgttatccccctgtatgaggcaggttacccacgcgttactcacccgtccgccgctcagtcccttacatcttcccccgaaggttctgtcgtaagcgcttcgctcgacttgcatgtgttaagcacgccgccagcgttcatcctgagccaggatcaaactctctgatatagtgtttgtccaagttcaagataactacttggccatctatcccttttactgttttggttcatcgaaccgttcttttttaaataaatgaatgtaaaagaattttcgttttcatgtgtttcactgttcagttatcaaggttcctgtcgttctttttatcagcgacagcttttatattatatcaaagctgtttttgtttgtcaagaacttttttaacttttttcaaagttttttatttttgatttgttgtcgttttcctcgacatcttttatattatatcaaagctgtttttgtttgtcaagaacttttttacttttttttattccaagtaattctttttcttgtcgcaacagcttatttagaataccatatctaacataacttgtcaacaactttttcaatttactgataatttagattaagttctgtatttttcagtcatttgttagtgacaactctgatactatatcacagcctttctctgtttgtcaactagatttttaacaaacttttctttttcatttcgttttcattatattcgattttccgaatctctttttttgtatgcttgacaggagatttctctaatgctatactcaactttgaaattttatataatagacagttcgtttgcaccatcctgtctttaaataaaaccagggctatgtatattgtttcattctttgacatgatgcccattttgtgcatcatgtctttttaattttaaagaaatttctttattatcaaaaacaatatccatatccgtaaacgaacggaaaggatgattatgtatctattaaaaacagagcagacttttgactccgctcactttctttctgattatcaaggcaaatgtcgtaatcttcatggacaccaatggcgggtaatcgttgaaatctgtggcaaaactttaagcactgatactcagacccgcgatatgcttgtagactttggtgatttaaaacatgacttaaaaacagaaactgatttttttgaccatgctttaatcattgaaaaaggcagtcttaaacctactactttaaccgctttacaggaagaaaatttcaaaattgttgaactcccatttcgaccaactgcagaacgcatggcatcttatttttatacaaaaatgaaattccatggctacactttaaggcgggtaaccgtatatgaaaccccaaaaaactgcgcgatttatgaggagtaatcaaactatgtcaactcaagcgatttatgatgttgttgaaatttttacaagtatcaatggagaaggtccattggtcggacaattggctgtttttattcgaatgaaaggatgtaatctttcctgcagttactgcgataccaagtgggcaaacgaaacagatgcccctgcaagagaaatgacggcaaatcaaatttatcaaaccattttagaatccggtattaaaaatgtcaccttaactggcggagaacccctttaccgtccttttataaaagaactcttaaaacttctggcatctgattcttctcttcatattgaaattgaaacaaacggaagcataaaccttgaaccattttgtgatttaggaacttctgtttcttttactatggattacaaactctcatgcagtaacatggaacaaaagatgtgtttaaataatttttctattttagagccaaaagatacagtaaaatttgttgtaggttcacttgcagattgtcaaaaagcatttgaaataatacagtcctatcaattagaaggtcgatgccacatttatctcagtccagtgtttgggatgattgaaccctctcagattgtagaatttatgaagcagaataaaatgaatggtataaatcttcaaattcaaatgcataaggtaatctgggaccctgaagaacgaggcgtttaactatatattccgagaatacctaaatttattttcatgatggaggttatttatttatgaaagctttagtattatccagtggcggggtagacagcacaacctgtttaggtcttgccatagaaaaatatggaaaagaaaatgtgattgcacttgcaattacttacggtcaaaaacataccaaagaaatcgaggcagcgagagctgtcgctgattattacaatatagaaatgttacattttgatttgtctactatttttcaatatagtgactgttccttgttaagtcattcttctcaggaaattccagaggaatcttattcagaacagctaaaacattcggatggaaaaccggtttctacttatgttccatttcgaaatggtctgtttctttcctgtgctgcaagtatcgcactttcaaaaaattgtgatgtaatctattacggagctcacagtgatgattcagccggaaatgcttatccagactgtagtgatgcatttcaaaatgctatgaaccaggcaatttatgaaggaagtggacatcaattaaaaatagaagctccttttgtaaatctaacaaaagcggatgttgttcgtaccggacttgacctgcatgttccttatgaacttacctggagctgttacgaaggtaaagagaaaccttgcggtcattgcggaacttgtattgaccgtcaaaaagcatttgaacaaaatggtgtaacagaccctgctctcgcttaaatataatatattgcaaaaaaatctagactgttcccttattattaattgatattatcgacagcctagattttttttaattttcagtatacacaaaaaaccacctatttatcatagatggcttcccaaataaaaaagctccccctgttggactcgaaccaacgacactgcggttaacagccgcatgctctaccgactgagctaaggaggaatattcattcatcgtaccttcaaaactacatatacaaaaccgaaaccatgcagacacttgccgctccgctgatttctcagcttctggtcaagccctcgaccgattagtagcagtcagctccatacattgctgcacttccacctctgccctatctacctcgtcgtcttcaaggggtcttacttctcacgaatgggatatctcatcttgaggggggcttcacgcttagatgccttcagcgtttatcccttccaggcttggctactctgccatgcagttggcactacaacagatacaccagcggcctgtccatcccggtcctctcgtactaaggacagctcctctcaaatatcctacgcccacgccggatagggaccgaactgtctcacgacgttctgaacccagctcgcgtaccgctttaatgggcgaacagcccaacccttgggacctactacagccccaggatgcgatgagccgacatcgaggtgccaaaccactccgtcgatgtgaactcttgggagtgataagcctgttatccccagggtagcttttatccgttgagcgatggcattcccacttaataccaccggatcactaagccctactttcgtacctgctccacccgtcggtgtcgcagtcaagctcccttctgcctttgcactcttcgaatggtttccgtccattctgagggaacctttgggcgcctccgataccctttcggaggcgaccgccccagtcaaactccccgcctggcattgtcccaccgccgggtcacggcggctggttagaaacccaatactgcaagggtggtatcccaacatcgactccgtagcaactggcgtcactacctctcagtctcccacctatcctgtacatgcaataccgaatcccagtaccaaactggagtaaagctccatggggtctttccgtcctggcgcaggtaaccagcatcttcactggtacttcaatttcaccggatgcattgccgagacagcgctcaaatcattacgcctttcgtgcgggtcggaacttacccgacaaggaatttcgctaccttaggaccgttatagttacggccgccgtttactggggcttaaattcaatgcttcgtttcctgacatctcctcttaaccttccagcaccgggcaggcgtcagcccatatacctcacctttcggtttcgcatagacctgtgtttttgctaaacagttgcttgagcctattctctgcggcccgcttttacacgggcaccccttctcccgaagttacggggtcattttgccgagttccttggcaatgcttcttccgtcggccttaggattctctcctcatccacctgtgtcggtttacggtacgggtacgttacaaacaatagcggcttttcttgacgcatggctcacacacttccctactctagttcggtccgcatcacgcctttggattgccacacggtttttcctatgtgactcctccttcgcttgccccgggattccattcccaggatgtgctttccacacgtgtccccacagttctgttctaacgcagtacaggaatctcaacctgttgtccatcggctacgtctttcgacctcgccttaggccccgacttacccagggcagatcagctttaccctggaaaccttagatattcggccataaggattctcaccttattctcgctactcattccggcattctctcttcaatacagtccacagctcctttcggtactgcttcttcccgtattcaatgctcctctaccaatgtattactacattcctcagcttcggtgtcgtgttttagccccggacattttcggcgcaggacctctcgaccagtgagctattacgcactctttgaatgtatggctgcttctgagccaacatcctggttgtcttcgaaatcccacatccttttccacttaacacgtactttgggaccttagctggaggtctgggctctttcccttttgactatccaacttatctcgtatagtctgactcccgataatcaattccatggcattcggagtttgatattcttcggtaggctttgacgccccctaggaaattcagtgctctacctccatgtatctctatcgaggctagccctaaagctatttcgaggagaaccagctatctccgggttcgattggaatttctcccctatccacacctcatccccacccttttcaacggatgtgggttcggtcctccactgcctcttacggcagcttcaacctggacatggatagatcacccggtttcgggtctgcacatactgactctggccctattcagacttggtttccctacggctccacgcctttagcgcttaaccttgccagcatgcacaactcgccggaccgttctacaaaaagtacgcggttccacagcttgtaaagcggttccacagcttgtaaacacagggtttcaggttctctttcactcccctcccggggtccttttcacctttccttcacagtactatgcactatcggtcactaaggagtatttagccttacggggtggtccccgctccttcccacaaggtttctcgtgtctcgtggtactctggatcctgccttgtcctctttcctttcccatacggggctttcaccctctctggctggctttcccaaaaccattctggtagaatcaaggaatcaattttgcagtccgaaccccagcatgcacgcacactggtttgggctctttcccgttcgctcgccgctacttaggaaatcgagttttctttcttctcctcggggtacttagatgtttcagttcccccggttcccctccatacgttatggattggcgtatggatacatgaggtcttctcatgtgggtttccccattcagatatctccggctcattggatatttgctcctccccgaagcttttcgcagcttatcacgtctttcatcggctcttagtgccaaggcatccaccctgcgctcttttttgcttggccattcagatcttatagcgttaacatctgacggctggtgttgcttggtttgtttctatttcttcgctgtatttctacagcgcctcgtttcgtctctatcttacgttttacgtattttagatgtttcgtatatgcagttttcaaggtacgactacggtagtaaaattttcgttttcttaccgagtggagataaagagattcgaactctcgaccccctgcttgcaaggcaggtgctctcccaactgagctatatccccatatttacttttttcctctgggtattacccagtgggcttaagtggactcgaaccaccgacctcacgcttatcaggcgtgcgctctaaccagctgagctataagccctcttttgtaatccggcagccacctgctttcccatgccgtctccagcatagtatcatcggccgcttaagtcttaaccatcgtgttcgggatgggaacgggtgtctcccctaagcgcatcgccaccggaaatatgttgttatctgttttttattgataactcaacagtgaaacacttcttaactacttcttcttccttagaaaggaggtgatccagccgcaccttccgatacggctaccttgttacgacttcaccccagttatcaatcccgccttcggcagctccctccctaaggttgggtcactgacttcgggcgttactgactcccatggtgtgacgggcggtgtgtacaagacccgggaacgtattcaccgcgacattctgattcgcgattactagcgattccagcttcgtgcagtcgagttgcagactgcagtccgaactgggacgttatttttgggatttgctccccctcgcgagctcgcttccctttgtttacgccattgtagcacgtgtgtagcccaaatcataaggggcatgatgatttgacgtcgtccccgccttcctccaggttatccctggcagtctccacagagtgcccagctttacctgctggctactgaggataggggttgcgctcgttgcgggacttaacccaacatctcacgacacgagctgacgacaaccatgcaccacctgtcttctctgtcccgaaggaaaggttccattacgaaccggtcagatcgatgtcaagacttggtaaggttcttcgcgttgcttcgaattaaaccacatgctccaccgcttgtgcgggtccccgtcaattcctttgagtttcattcttgcgaacgtactccccaggtggaatacttattgcgtttgctgcggcaccgaagagctttgctccccaacacctagtattcatcgtttacggcgtggactaccagggtatctaatcctgtttgctccccacgctttcgagcctcaacgtcagttaccgtccagtaagccgccttcgccactggtgttcctcctaatatctacgcatttcaccgctacactaggaattccgcttacctctccggcactcaagaaaaacagtttccaatgcagtcctagggttaagccccagcctttcacatcagacttgctcttccgtctacgctccctttacacccagtaaatccggataacgcttgccccctacgtattaccgcggctgctggcacgtagttagccggggcttcttagtcaggtaccgtcattttcttccctgctgatagaagtttacataccgagatacttcttccttcacgcgacgtcgctgcatcagggtttcccccattgtgcaatattccccactgctgcctcccgtaggagtctgggccgtgtctcagtcccaatgtggccgttcaccctctcaggccggctactgatcgtcgccttggtgggccgttacccctccaactagctaatcagacgcgggtccatctcataccaccggagtttttcacaccgtatcatgcgatactgtgcgcttatgcggtattagcagccgtttccaactgttatccccctgtatgaggcaggttacccacgcgttactcacccgtccgccgctcagtcccttacatcttcccccgaaggttctgtcgtaagcgcttcgctcgacttgcatgtgttaagcacgccgccagcgttcatcctgagccaggatcaaactctctgatatagtgtttgtccaagttcaagataactacttggctatctatcccttttactgttttggttcattgaaccgttctttttaaaataaatgaatgtaaaagaattttcgttttcatgtgtttcactgttcagttatcaaggttcctgtcgttctttcttatcagcgacagcttttatattatatcaaagctgtttttgtttgtcaagaacttttttaattcttctttttaagaaaaattaaacggagaaggagggatttgaaccctcgcaccgctattaacggcctactccctttccaggggagccccttcagccacttgggtacttctccaaatgcctaaatgatattttcatttagtgagcggagagagtgggattcgaacccacgcgcccttgcggacaaacggttttcaagaccgcctcgttatgaccacttcgatatctctccatctttgttttattctgtttgtttatcgctctgtgttagcgacaagtgatattctagcaccagttgttccaaatgtcaacactttttttgattttttttatttttttattttttccgtttttttattctttttgttttattttatcagggaaagatttcgccctctttccctgatatttactggaatttttaagctttttactcctgtttggcaaagtttttaaaagtgattctactcttcctctaacgtctccaaaatctgctccgcaagtaaaatatcttccggggtcgtaatttttatattatcataagccccttcttccaacttcacttttaatgaaccatattgttccattaccattgcatcatccgtaattccctgcattccttcctgctttgccttttgatatgccgaataaatttccggataggagaaaatctgaggagtctgaatattccagactcgagcccgttttggcgtagattctacaaatccctcttcatctgcaatttttactgtatcttttgatagtacgcctaaaacacacgctccgcctgcaatcaccgctttttttccgcgctctatcatttcctctgttacaaatggtcttgcaccatcatgaataaacacataatcacagttttgacatgccttaagtccttcataaacagaatcatagcgttcttttccacctgtaacgactgcttttaccttttggaatccaaacggctctacaatctctctttttacatattcaacgctttctgcacctgttacaataatgatatcatcaatttcactgctcttttcaaaacaagaaatactataaaacagaaccggtttcccttttaacaaaagaaactgcttctgtattttactcttcattcgttttccctggcctgctgccagcacaattgctgtacagttcatattatcgccccttatactaacgttctcccaatttcaggtttggaactgcatttaaatccattccatgtctcgttccctttaaaaattcgtaatacgcagccacaccaatcattgctgcattgtccgtgcagaaaattggtgatggatgataaaattttatctgattttttttacatgcttcctccatcgcactgcgaagtccgctatttgatgcaacccctccggcaatcgccagttttttaatatgataatcttttgccgccataattgcgtgttccacaagtacctcaaccacacagcgctgaaaagaggctgcaatatctgctgctacaatctcttccccctgcattttgcacttgtttaaatgatttaataccgctgattttaccccactaaagctaaaatcataaggagcatcttcaatcttggcctttggaaaatcaaacgcataaggatttccctcttttgaaagtttatcaattttcggtccacctggatatcccaatccaattgctcttgcaactttatcaaatgcctcacctgctgcatcatctctggtacgtcctaaaatttcaaactcaccataatcttttacaataaccagatgtgtatgacctcccgatacaaccagacataaaaatggcggttctaaatccagattttcaatataattggcagaaatgtgcccctcaatgtgatgcacgcctaccagtggtaaatcttttgcaaaactaattgcttttgcctctgccactccgactaaaagcgcaccgacaagcccaggtccataagtcaccccaatcgcatctaaatcatctaaagtaacccctgcttcttttagcgcctcttcaatcacctgattaattttttcaatatgttttcttgatgcaatttccggcactactcctccataaagtttatgaaggtctatctgtgaagaaatcacatttgataaaatagtacgtccatttttcacaacggatgccgcagtttcatcacaggaactttcaattgcaagaattttaatatctttttgtgtttctgtctccacgtttttttctcctttcccatgtactccattccaatgtacgctcgaaatttttctgttaaaagctctcaaaactcaaaacgtacctcaatatctacaatatctatctgatatcatcttaagtttctgctactcttcttcaaactgcagttctaccgactggcgatctcttgctgcaatcgtattttggaaaatttttgttgcctctcccaatgcttcttccggtcttaccagtgacggactgtaatgtgtcagccagagttcctttacattggcactttttgctaatgttgcagcttctttaaacgtcatgtgtttatgtgcctttgccttttcctcttctttatcctgctctccatacattccttcacagataaataaatctgagtctttcgcatgctcttctatagatttgaccggtctggtatctgtcgtataagtcagtttaattccctttcttgccggtcctaataccatatccggagtataaagcatgccatctgcctctactgtctcccctttttgcagtggattccaatattttaacggaatattctgttcctttgctctttttgcatcaaattttccatttctcttaatttctatcgtatatccataacaaagtacattatgatttactttatatgccgtaatctcatacccatataaagtaaaagtctcttccgactgagtcaactcaatacattcaatttcaaaaggcagttccggtgcaatcacacgaagcgcatttaccacacggacaagaccttttgggccaatcaaagtaagaggctcggttcgctctgcatttcccattgtcaaaagcagtcctggaagcccactgatatgatctgcatgataatgggtaaaacaaatcacatcaatcggcttaaaactccagcctttttcctttacagcaacctgagttccctctccacaatcaatcattaaattacttccgttatagcgtgtcattaaagcagttaattttcgtcttggaagcggcatcattccaccggttcctaacagacaaacatccagcatctatcttttatcctcatttctctctgattttgcagagatatctgcgttttttatcttaacacacatttttgactgctacaacaattccttttcttttttcacggtaagtggaattacaaaatctgcggttattctatcatagcacgcttcacataaatcaaattcatggtgttctgtatctttatttgaaaaatatccccataaaatctctccatgaaacattccttcctgaatcatttcgttttttatggttattttttttccacatccattacaataaatttctgccagttttttttctttttgatttttatattttctcatccttatcctccaaacggatgtcatatactttcaaactctctctttttgatttactttgtactctcgacttgtttcttctgtattataccgaatttttttcaaaaatcctatatgaaaccattttcaaatatagaaaaagatagcaattctgctatcttttacacataacgattccatcttcgaccggctcttcataaaactttttccgcacatcaatctcttcaaatccaaaggaacggtataactttcttgcacgtagattactctctcgcacttctaaaaagaaagacatcccccctctttttttcgcttcttttaaaaattcctccataagatgtgttccggctctttgtccccagcaggactttttaattgacacatttgtaatctcgccctcatctaatacaagccacattcctgcataaccaatgatttcatcttgattctcaatcaccatgtacaacgtatttttagaacgaactgcatcttcaaaatccttttgcttccacggctttgaaaaattttcagcttcaatttgagcagtttcttctgcatcctctattgtcatttcacgcacttttaataaattttttttgatattctcactcatgtttttcttgtttcaaacgttctgcacgttctctttctgcctgagaaacacgaagatactccggcttatgttctgctgcactttctgtttttccctctttaaaataaagagtaccaagcatgccaaccgcccctgcacgctgtctgcttaaatgtgccggtgcaaatgaatacggcactttacagctttcctgaatcaattctttataaaccggaacagcgtcgccaagaaaaattaccggtctttccatttgatttaattcttttatcaattcctctaatgcaactgcatcctgttcttttaccacctgcatctgatgatttaaaaagcaatacattcctgtataaacctgttttcttcttgcatccataatcggacagataatcgtatcttcatcggtatcatataaattataagctagtgcatctaccgtcggcacgctgattaacggcttatctaatgcaagtcccagtccttttgctgtcgccgaaccaattctaagccctgtaaaagaacctggtcctgctgccactgcaattgcatcaattgaacttaaattcaaatcaatactcttttttatttcttctaacatcggaagcaaagtctgggaatgtgtttttttataattcatcgtatactctgccacaagtgtttcttcttctatcacagccacagaagctacaagccccgaactgtcaattgctaataatttcattgtcttctctcctctctggtttcttgttctgcttttttattccatttctgtcttagctaaaccatctattgtgatttttcgataatcaaatcctttttccggatttttttcaattgtaattgcaatgatagactccggcaaaagctcttctattaattccgcccattcaatcaggcaaattcctttcccaaaaaagtaatcatcgtatccgatttcttccatttcttcaatatctccaattcgatagacatcaaaatgataaaatggaagccgaccgccttcatattcttgaacaatcgtaaacgtcggactgtttaccggttctttgattccaagtcctacagccactccttgagtaaatacggtctttccggttcccaaatctccatttaaggtataaatctgtcctgcaaccgctttttctccaagccgtttcccaagttcaaatgtttccttcgcactatttgtttctattatcatattttgactcactttctgtttctatacaaaatgacatcattttctgtttctttcatccgagcgagtattcgtcagaatatcgttacggtaaaacagacatttgcaatccgctttgttacttgctcaccacttagtgatctgcgcacttgaagcaggagaatgcttatctgcggtaaagcggacattcgcaatccgcttcgctacttgctcatgaacgcagtcgcttcgcgatctgtcagtgggagctttcaactcccactgacagaagcatccccctcacccgccgtttagtgctctgcgcacttgaagcggggggaatgcttatctgcgttcaaatctcgattctacattataacacagaaaattatggcttgcaccttttatttttccagattataatggtatctgaaccttttggtgctgccggttttattgttttgataagactttttaagtgcagtaacctgttcgcaaaaaaaattaaaggagatacaaattatggctaatccaattgtaaccatcacaatgacagatggcagtgttatgaaagctgaattatatccggaagttgcaccaaatactgtaaataactttattagtctggttaaaaaaggcttctatgatggtcttgtattccacagagtcatccgcggatttatgattcagggcggcgacccacagggaaccggaatgggcggtcctggctattccatcaaaggagaatttacctataacggtttttccaatgatttaaaacatacaccaggtgttctttccatggctcgcgcaatggatccaaattcagccggaagccagttcttcattatgcatgaaacttccccacatctggatggacagtatgctgcatttggaaaagtaactgacggacttgacgtggtaaataaaatcgctgaagttccaactgactacagtgaccgtcctcttgaaccacagatgattcagaacatgactgtagatactttcggagttgaatatccggaaccggaaacggtataattttatcagtcttcaaatgtaagaacttctttatcaagaatggcataatacagttctttttctgccgtgacagaagcttttccgctcgttgcttccgtcacggctttttttatgcgttcttcttcttttttcggaactaatacttcaaattctacactttctgtatatcttgaatctaaaatcggaagattctcctgcccaaacagatactgcagttttccgactccattataatctgttccaactaacagacatactccatggtttttggtaattaaaatactgttttttaatccttcctgaacggcttttgaatatgcccttacaagtcctcccgttcccagcagagttccgccaaaatatctggttactacaaccgcaatattatacagttcttctccaagcaaaacatcaagcattggttttcctgccgttccctgtggttctccatcatcactgcagcgcataaactcttttctttctccaatcacataagcatagcagttatgtctggcatcccagtatttcttttttatctcttcaataaattttaaagcttcttcttctgtttttaccagacggacagttgcgataaaacgtgactttttttctacgatttcgccctctccgccctgatagactgtcctatattgttctaacatctttcttatccttacctgattctttttaaattttcttcatcataccacagaaatttacaggtgcaaagcaataattttcccctgaaaagtatcaaaaagtgtgaattttatcaagttagactttatttcgcacagggcatttgctataataaaccggtaaaggaggcaaaatacatgaattttggaaaacgtgcgacaaacagaaaacgaaatgccctgtcctcccactccacaatgatagggaaaaaagcaaatgtttctgttctacgcattctgtttatttcactgattgcagtttttaccatctgcttatgcatcggggtaggagcttttcgaggtctgattgacagcgcaccggatatcaatgatgtcaatatcatgcctgtcggctctgcaactttcatttatgactcagacggcaatcagcttcagaaactcactgcgcctaattccaatcgtatgccggtatcgattgaccagattccacttgatttacaacatgcagttgttgcaatcgaggatgagcgattctacgagcataacggaattgacctccgcggtattatgcgtgccgctgtaaaaggtattacgcatggattcaatttttcagaaggtgccagtaccattacacaacagcttttgaaaaataatgtgtttaccgactggacaaatgaatctacaattgaacgttttaaacgaaaatttcaggagcagtaccttgcagtccagttagaaaaggaactgaaagacaaacagaccattcttgaaaattatttgaacacaatcaatcttggagatggaaattatggagtgcaggcagccgcacacggatattttaataaagatgtcaatgaactgaccctttcagagtgtacggttcttgccggaatcagccagaacccaacccgctataatcctgctacaaatcctgaggaaaatgcaaagcgtcgaaaagaagtactcgaccacatgcttgcccagaattatatctcgcaggagcaatatgatgaatgtcttgctgacaatgtttatgaaagaattcagcaggtagaggcagaaacttctcaggaagacaccacttacagttactttgtcgatgaactgaccaaacaggttgtcagtgacttaaagacccagaaaggatattctgaccagcaggcttacaatgcactttacagtggcggacttcgtatttatacgactcaggaccctaatattcagcagatttgtgatgaagaatattcgaatcctgccaactttccttctggtactcaggtggaactggaatatgcactgacaatccgccgtccgaacggaacggaagaaaacttcagtcaggaaatgatgcagtcttatttccagcagcaggaaggagaaaatttcaatctgctctttgacagcgcagaacaggctcagaattatatcgacacctacaaagctgctgttacctatgatggctctgaagtgctctcagaaagcattacaatggcacctcagccacagtcatctgtggtaatcatggatcagcacaccggatatgtaaaagcgattgtcggcggacgcggggagaagaccagcagtctttccttaaaccgtgcaacatccactctaagacagcctggttctactttcaaattagtatccacttatgcacctgctttaaatgaatgcggaatgactcttgcaaccacttatacagataaaccaatcacttataaagacggtacaccggttaagaatgcaacaaattcttatcgcggagaaacaaccatccgcgaggcaattattcattctattaataccgtagctgttcagtgctttaccgatgtcactccacaacttggatatgagtatctgaagaaattcggatttaccactgtttatgacaatatcagtattaatggtaagatttatactgacattcagcagccaactgcgctgggcggtattacgcgcggtgtcagcaatctggaactgactggcgcttatgctgcaattgctaattccggaacttatatcaaaccaatgttttatactaagattctggatgaggacggaaatgttgtcatcgacaacactccggaagaaagaaaagtcattaaaccaagcactgcttatcttttaaccagtgcaatgaaggatgttgtaagcgaaggtaccggtacaagacttcagctttctaatatgcacgttgcaggtaaaaccggtacaaccgatacctacaatgatgtatggtttgcaggattcacaccatattacacctgtacaatctggtctggatatgacgataacaccaagatcccggataccggaaattacagaacctatcatcaggacttatggaatcgtattatgagccggattcatgaaaatctcgaagataaagattttgacaagccggctactgttggtgaagcaactgtctgcaaagacaccgggatgcttccaacttacaattgtccgactgtaacagaactgtttgataccaccgaacttccaaccaagcgctgtaccaaacatggcggtggtggtagcagccgaagctatagttcttacagttcaagaaattcctacagttattcggataatgaagatgacgacgaagaagatgataccgattcttcttcctctgatgacgaggaagataataccgataacgaagaagaataaactgtaaaaatttaaaaacacaacaaaaaagactccgttctcgaaaaagttgagaacagagtctttttatttactatcctgattttttactacaatcttcttaattatctttgcttaaaattaattttgcagctccataaattccagcatcatttcccagtgttgccagtttaatcggagtttctttgcttgcagtaaatgcatgtgctttataatatttttctactgcatcaattaaaacttgtccggcttttgataccccaccaccgattacaaatacatcagggtcagaaacacaggcgaatacagccagtgcattgccaagataagcagcaaatttatcaacaattttacctgccagtacatccccttctttataggcatcgaatacactctttgctgaaatattttttacagttctaagcacagaatcttctgcttcactttccagcgcctcttttgcaagacgtgcaataccggttgcagaagcatactgctccagacaacccttatttccacagttgcatgctttggtttctgccggatttacaaacgcatgaccgatttcaccacctgctccgtgtgctccggttacaattttttcatttatgatgattccaccgcctacacccgtacctaaggtgaccagaatcaggttctttgcaccctgtccgccacctttccacatttcaccaagcgctgcaacatttgcatcatttccggcttttactgcaagtccggttaaatcaccaagttctttttcaatattttttcttccccaatgaagattcacggcgcatggaatttctcctgtttcttctaccggtcctggtacaccgattccaacacctgcaacttctgccttatcaattttcttttcttcaatttttgcaagaattgttgccgctatatccggaagaattgcttctccattattttctgtacgggtcacaatctcccatttttcttctactgttccatccgtctgaaacagtgcacattttacagttgtaccaccaaggtcaattccaaaacaccacttttccattattcatcttcctcttttctcttttttgacatattttcctgtacacgacgatacagttcctgagctgcattatagcccatcttcttctgtctgtggttaaccgcagccgactctacaataacagccagatttctacctggacgaattggcagagaatggcatactacacggtttcccaaaaattcagtatactcttcttccaatccaagacggtcatattctttgtctttatcccactcttccagcttgataaccaaatcaatagactgagtatcttttacactttctacaccaaacagggtctttacatcaataattccaataccacgcagttcaataaagtgacgggtaatatccggtgcagagccaaccaatgttgcatcactgacacgacgaatttctacaacatcatcgctaaccagacggtgaccacgtttgattaactccagggcagcttcactcttaccgattccactttcacccataatcagtacaccttcaccatatacatcgactaatacgccatgaatggaaatgcacggtgcaagctctacattcaaccaacggataatctctgccataaaggtagaagttgtctggtcagttacaaaaatcggcacatcatatttaattgcaagattaatcatatcttcatccggttctgtctttgtactgaaaatcacacacggaattttacttgctacaaaacgttcaaacgcttccatcttcttttctctggataaatgcagaagatatgtgtattctacatatccgataatctgaactctttcattttcaaaatgttccagatatccggtcagctgtaatgctggacggttaatatccggcagggtaatcctcttttttgagatatccacatccggtgttttattatgcagatttaattcctgcaccattttgcttaattgtacacctttcactttttaggcctccttgttttccctgaacgcaaccttatgataaactattttttgcgcacattcgctttgataatagtttatcataaggtgtttagaagttcaactgcaaccatatcaagaattcgtcaacttatgccgtcaaaatcatatgtcagttcttacaaatgtttaacttaaatttcacgcatttgctttatgaaaaaagtcatacactgcctgcgctgacttttcattcatcgaagaaacttcagccagttcttccactgttgcctcttttattttttccacacccataaaatgtttcatcaaagcttttcttcttgccggaccaatcccttcaatctcatcaagcacagaatgaatctgatttttacttctcaaagaacgatgatattcaattgcaaaccggtgtgcttcatcctggattcttgtaatcaatcgaaacgcttcactgtctttttcaatcggaatttcctgattttgataataaagacctctggttctgtgtttatcatcctttaccattccacaaaccggaatctcaagttttaatttttcaagcacggacaacgcagaatgaacttgtccctttcctccatccattagaatcaagtccggaaatttcgtaaagcttccatactgttcttcctgatttttttcttcttgctgttgtttttcttccattccatgttcaaatcgtcttgtcagcacctcttccatgcttgcataatcatttgaaccttccacagtctttatccgaaatttgcggtaatcactccgctttggttttccattttcatacacaaccattgaaccaaccgacaaaaatccactgatattggaaatgtcataagcctccattctctgcgtacttgaaagatttaaaagtttactgatttcttttaccgccccgatggttcgtccttcttcccgctttaatcgttctttatctttttcaagtaccagcctggcattattttttgcaagttctactaatttttcttttgttcctttctttggcacacgaatctgtacctttgttcctctgcggtttgaaagccaggtttcgattattacacgatcctcaatttcgctctcaatcataatttcctttggaatcattgcagttcctgcataaaactgtttgataaaactcgataaaaccactgctttttcttctcctgccgtgtgtaaaaagaaatggtctcttccaatcatttttcctccacggataaaaaatacctgagctactacatcgtcattttcctgtgccactgcaatcacatccctatcttctccatgctggtctgtgattttctgacgctctgcaatcttttttacgctctctatcaaatcacgatactgtgccgcatcttcaaaacgcagttcttcggacgcccttaacatcttttgttccagttcttttaaaatttctttatgatttccattcaaaaacgaaatcagctcttctacctttttatgatactcctcttttgaaatatacccctgacaaggtgcctcacactgatgaatctgataatacagacagggtctttcttttttgatgtcctttggcagatttcggttgcaggttcttaaatggtatagttttgttacaagctccaccacatcttttactgcaagaccgctggtatacggaccataatactttgctttatccttcttcatctgccgtacaatctgaatcctcggatattcttcctgcaaagttactttgataaatggataagtcttatcatcctttaacatggtattatattttggtttgtgttctttaattaaattacattccaataccagtgcctctaactctgaatccgttacaatgtattcaaatcttgcaatctgttccaccatctgttctttctttatccccagatttcgactgctttgaaaatactgccgaacacgattttttaaactgattgcctttccaatatagataatcgtatcctctgcatcatgcataatataaacccctggttttcccgggagcttctttaattcctcttcaatacaaaacaatttttcccatcctttctccctgtattgaaagaagctatcacattcctgcgatagcttctctgtttctttaatcgtttctttaatcatttaattcgtttttagccagtactacttttggtgtttccttttcttccaccttattttctacgatacgcggtttttcttttggttcgctttctcccttgatttcacggaaaatcttcataaattcttttccggtaatcgtttctctttcaatcaagaattcggcaatcttatcaagcgcttctcggttttcgcttaaaagccgttttgcttcatcgtaggaatattttaacaatttcataacttcatggtcgatttctgttgcagtggaatctccacagttcatcacggctctgccatcgagatactggttctgcgtttccgcaagtcccatcagaccaaagcgttctgacataccatattgagtaatcatggctcttgccactttggttgcctgctcgatatcatttgctgcaccggttgtaacggtatcaaatacaatttcttctgctgcacgtccgccaagataaccaaccagcattgcctcgagttcttttttggtatttaaatatttctcttcttccggaacatgcattacatagccaagtgcgcccattgtacgcggtacaatcgtaatcttctgtaccggctcagaatctttctggagagcgctgaccagtgcatgtccgacttcatggtaagaaacgattcttctctcttccatgcttaagatacggtctttcttttctttaccaactaatacaacctcaacggcttctaataagtctttttgcgaaaccgcttttcttccattttttacagcaagaatggcagcttcattaatcatatttgcaaggtcagatccgactgctcctgaagttgcaagtgcaattccctctaaatcaacagtttcatctaaagatacatttttcgcatgtacttttaagatgctgacacgaccttttaaatccggacggtctacaataacacgtctgtcaaaacgtcccggacgaagcagtgcagggtctaagacttccggacggtttgtcgcagcaagaatcaaaagccccttagaagtatcaaatccatccatttctgctaacaactgatttaaagtctgttccctttcgtcattgcctccgaaacgggaatctcttgttttaccaatcgcatccacctcgtcgataaaaataatacaaggtgcatttttctttgcttcttcaaataaatcacgtactcgtgatgcaccgacaccgacaaacatttccacaaagtctgaaccagacaatgagaaaaacggtacgtgtgcttctccggcaactgcctttgcaagcagggttttaccggttcccggaggtcctaccagcagtgccccctttggaagttttgcaccaatctcggtatattttccgggattatgcaagaagtcaacaacttcctgcaaggattcttttgcttcatcctgaccggccacatctttaaatgtaactcctgtttctttttgtacataagcttttgccttactcttgccaacaccccccatcataccaccgcctttattcatacggcggaagaataatgaaatcagtgcaaacattagtacaaccggcacaacaaaacttaaaattgcatataagagttctcctgccatgtttggtttttcacgtttgaactctacatttgcctcatcaagtcgttttgtcaactcattttcatcttccgtggcaataacggtttttgtgccattccctaatttcccactgtttttcaacgttactttcaaatcatcagaatttatcactacactttctacctgacccttatcaagcagttggataaactcactataggaaatttcgctggatacattacttgtcattctggacagcatattcattccaaacagactgaccataatacagattaaaagtaccagaagggattgtttattcttaggtcccttattattattcgggtcctgattgcggttttgattttgatccatcttattcctcctcattctgtcctttctattatacgaatagcttgttaaaaaatcaattaaaaaactcgcttcaaatctaaaactttcatgaatttatttgttattctgccaaaagtttcttttttttgtttcccctactagaattttgcctgctctttgtagtataataaattttgtatgagtaaaaacagagtaaaaagaaaggcataaagaaaatgaagataggatttgataacgaaaaatatttatctatgcagtctgaacacattcgtgaacgcatcaaccagtttgacaacaaactgtatcttgaatttggcggaaagctttttgatgactatcatgcatcaagagttcttccgggatttgcaccggacagcaaactgcgcatgttaatgcagttagccgaccatgcagaaattgtcattgtaatcagtgctggagatattgaaaaaaataaagttcgtggtgaccttggtattacttatgatgctgatgtactgcgtcttagagaagtttttcaggagcgtggactttatgtcggaagcgttgcaatcacacagttttccggtcagccggctgctattaatttcaaaaagaaactggaaaaactcggcatcaaagtatatattctctactccattgatggctatccaagcaatattccgcttattgttagcgatgaaggttatggaaaaaatgattacatcgaaacaacaagaccacttgtagtcatcaccgcacctggacctggaagtggaaagatggcaacctgcctctcccagctctaccatgaacataaacgtggagttcatgcaggatatgccaaattcgagactttcccaatttggaatattccgttgaaacatcctgtcaatttagcttatgaagctgcaactgccgacttaaacgatgtcaatatgattgacccgttccacttagaagcttacggtgaaacaacagtaaactacaaccgtgacgttgaaattttccctgttcttcgtgcaatttttgaccgtattttcggaaaatgcccatatcagtccccaactgacatgggggtcaacatggccggaaactgtattattgatgacgaagcctgctgcgaagcatcccgtcaggaaattatccgtcgttactatcaggcagtagacggacttgcagatgagactaagacccaggacgaagtgtttaaaattgagctgttaatgaaacaggcaaatatctccttagaagatagaaaagtaacggttgccgcaaaaaaacgtgccgaagaaaccggagcacctgctgctgcagtcgaattagacgatggacgcatcattacaggaaaaacttctgatttacttggtgctgcttctgcgctcttattaaatgcgttaaaagaccttgcagggcttcctcacaatcttcatgtaatttctccggcttctattgagccaatccagaaattaaaaacatcctatcttggcagcaaaaatcctcgtcttcatacagatgaaattttaattgcactttcaagttctgccgcaaccagcgacgctgcaagacttgcattagaacagcttccaaaattaaaaggatgccaggttcattcttctgttatgctttcttcaactgataaaaaaacattccagaaattaaaaatgcaggtaacctgcgaaccggtttttgaacgtaaaaaactatattaagatttcaaaaaggggcagacacagctaatccgctgtatctgcccctttcctttttgccaattttaccaatcaaaattatcaattaatcatcataaccattcgggttattagactgccatctccaggaatcttcacacatttctttgattccatattctgcggtccatccaagttcttcttttgctttttctgcacttgaatagcaggttgcaatatctccaggacgacgtgctttaataacataaggaatttttacacctgttgcagcttcaaagttctttacgatatcaagtacgctgtaaccttttccagttcctaagttataaatcttaagacctgctttttcttcaattttcttaagtgcttttacatgtccttttgcaaggtctaccacatggatgtaatcacgtactcctgttccatccggtgtatcgtaatcatttccgaatacacccagctcttttaattttcctactgctacttgagtgatgtatggcattaagttattcggaataccgtttggattttctccgattgttccgctcttatgtgctccgattggattgaaataacgaagcagtactacgttccattcagggtctgctttctgaatatcggttaaaatctgttccagcatagattttgtccatccataaggattggtacactgtcctttcgggcattcttctgtaattggaacaaatgcaggatctccatatactgttgcggaagaagagaaaataatattttttactccatgttttctcattacatcaactaaagttaaagtacctgcaatgttattttcataatattcccacggttttgccacggattcaccaactgcttttaaacctgcaaaatgaatacaggaatcgatggattctttctcaaatacttcatttaatgcatctctgtcaagaatatctgctttatagaaagtcaccggttttcctgtgattttttctactctctccagtgatttttcactcgcattacttaagttatctaaaacaaccacatcatagcctgcgctctgcagttctactacggtatggcttccaatatatcctgctccacctgttactaaaattgccatttgttgttcctccttttaaaacctctaagttttctgtttagaaacatcttttatgttctatattactttaccatttttttttgaaaaagaaaagccttaatttatttttcccataaatattccggatacagaccttctgctttcatacgtttaattgcagccacaactaccggtttgtcttctttataggttacaccataccatttatctgtagattttaaaacctgaacagtcgctttttcttctgccagcagttctccgactacagaaggcaggaagtattcacattttaacggattcttttccagattttcttctaagaatttcggaaaacgattttttaactctgtcagcatactcggtgtaaatccccacatattcatggatacaatactgtcatttggaagtgctgtccatgtttcgccatcatcttccgtatattctgcctgttccccatgtttttcaatacgggttctctcacagattcctaccagatgaccgttttcatccgtctcgcagactcctcttgccacatgtccgttttcggtcaatgtattttccagcacatagccaaccatagtatagcggtatttttcatcatcttcgtgtgtggttaagaaatcatagattacctggaatgcatgagaaccatagtagtcatctgcattgataactgcaaacggagcatccacttcgttaatacagcttaagatagcatgacctgttccaaatggtttgacacgtccttcaggaacggtaaatccttccggaatgttttccagtttctgatagacataacttacatcaatcactttgcttaagcgatcaccgattgctgctttaaagtctttttcattttcctcttttataataaatactacttttttaaatcctgcttttactgcgtcgtaaatggaaaagtccataatgatatgaccctgttcatctaccgggtcaatctgttttaatcctccgtagcggcttcccattcctgctgccataacgaccaatatcggatttttcataatctatttcctccttataaaatcatcagatttctttctaattttaccacataactatctgtatcgtaaagctgacttgaatttctcaacgaaaaaagagccatttcttctaatttcgattcttatttattttatatttttatcttatattaattaaagcagacttaaaagctgtccactgaaattaattacaaaatgtaaatacatcgatgctttcaaagttccataacgttttactacagcaccaagtaccatccccaataaaaacgcatagattccctgtaccagattcagatgaatcataccaaaataaaatgcctgaatgatatttgccacccagaatggaaactcttttcttaaaatcacaaggcagagccccctcataagcatttcctctacaatcggtgccgtaatcaccacataaaatacagaaaagagactcggatttccacttcccagactctccattacttttgtataattctgcatcaaatccggtcgaacgatatacacaagattcaaaagaaaactgattgcaaactggacaaaaattcctaatactgcaagttttaaaagaaccgacagattcagattcttttgttgattccagaccggatattttccgcctgcccgcatccgtttataccagaataccccaatcacaaaaaatataaggtatgccagaatactaatcaggtacagcccttcctgttctaaaaatccagaaagccagttaccaaatactgttcctgacaccgcagtcattccaatcattcctgtaaaagtacagccacatgaaacaagaatttctattataaaataaactgcaatcggtgtcagacttaataataatgtctttatctttctgctcataattctttaaagtgaaactggctgtttccctgtgcataatctgccacaatctgtccctgtccgtataatttatatttataagtaacaagcccctccagtccaaccggacctcttgcgtgaatctttcctgtactgattcctacttctgctccaaatccataacggaatccgtccgcaaatcgggtagaacagttttgataaacccctgcggaatccactaactgcataaatttttctgcaatttcctgattttctgtaagaatacaatccgtatgatgagaaccataatgattgatatgtgcaatcgcttcttcttcgtcttctaccagtttaactgaaatcaccaaatccagatattctgtatgaaattcttcttctcccatcacttcacaagaaatgatttcactaacttcttttgttccacgaattttcactcctgcctcttttaaagcagtttcaagttccggtaaaaattcttttgcaatttctctgtgaaccaataaggtttccaccgcattacaggctgccgtatattgagtctttgcatccacaatcaccggaatggctttctttttgtcatactctttgtctacataaatatggcagacgccgtctgcatgtcccataaccggaatctttgtatgattcataatatactgaacaaaagaatttgaacctcttggaatcaataaatcgaccgattcatgacaggataagagttcatcaatctcattatgttgttctgcctgaagcatacagccttccggcactccgaccgaagttgctgccttataaataatatcaaacaaaatcttattggttcttgcagtttcttttccaccttttaagatagcgcagtttccgctttttaagcaaagcgaagaaatctgaaccagcgcatccggtcttgcctcaaagataattccaatcacgccaatcggacaactcacacgataaagatttagtccatcatctaactgtcgtgccagctgtacttttccaagcggatccggcagtttgattaattcgctgattccgtttactacatccatcagtttgtgttcatcaaatttcaggcgttttttcaccgccggtgcgattcccattttttctgcagcttccatgtcttttttattttccagaaaaattgcttccctatttaaaaggagagcctcctttaccttttcaagtgccagatttctctgcgcttctgaaagtcccgccagctttgggctgtcctgcttcatcttttttgttgcttctttcatattcatactgccgattcctcctgattttcggggataattttacttcttaccgctcattatagctcgaatttcctttgcttgcaatcccaattggaacaaagtacatcatgtacccaattttaccaaatgaaaatctaaattttttcataatccttatttaaaaatagacatagcagtgctataatgttcacacggcatatcatagtgatatgcaatttttcatattctttaattggaggattttatgaacattattatagtagggtgtggaaaagtcggacgcacccttgccgaacaactcagcaatgaaaagcataatatcgtcattgttgatattattgagaaaaaaattcaagacactaccgaagacatcgatattatgggatttctcggaaatgcatcaagtatcaatacccttctcgatgccggaattgaaacagcagaccttttaattgccgtgaccggttctgacgaactaaacctgctttgctgcctgatcgcaaaaaaggtaagcaaatgccacactatcgcaagagtgcgtaatccggtctacagcaaagaacttggatttctcaagcagagtctcggaatttccatgattattaatccggaacatgctgctgcgattgaaattgcacgtatcttacgttttccatccgcaattaaaatcgacacctttgccaaaggccgtgtggaattattaaaatttaaaattaagccggaatttaaattaaacaatatgtccgttatggaatttggtgaacgctataaaaacctgattctgattggtgcagtcgaacgtggagaagaagtcagtattccatccggtaattttattttaaaggataatgatactgtgtctgtcatcgcttcaccaatcaactccgctttgttctttaaaaaaatcggaatccatacacatcaggtaaaaagcaccatgattgtaggcggtggtactctttcttattatcttgccaagattctcttaagtatgaagattcgtgttttaattgtggaatccaacgctgcccgctgtgaacagttaagtgaattattaccggacgctaccattatccacggagacggaaccgataaaaatctgctcttagaagaaggattgacccgtgtggaatcttttgttactttaactaatctggatgaagaaaacatcctgctttctttatttgccaagaaaaacagtaatgcaaaattggtttcaaaagtaaaccggattgcgtttgatgatatcattgaaggtcttgatatcggaagtgtgatttatccaaaatacattactgccgattatattcttcaatatgtccgtgccatgcagaacagtatcggaagcaatgtggaaaccctttatcagattcttgataataaagcagaagctcttgaattttccatccacgatgactgtccgtttttaaatatcccgctggctgacttagatatccgcgacaacctcttagttgcctgcattaaccgaaatggtgtcatcctgattccaagaggtcaggactcgattcaggcaaaagatacagtcgttgttgtcactacaataaaaggactcaatgatattcaggatatcctgaaaaaatagtttactttattactaaaaggaaaatcaaattatgaattattcgattattgcttatatcattggatggattttaaactttgaagctttatttatggcacttccctgtataactgcaattttctaccatgaacattccggctgggcatttttcttatctgctatgttctgcctcttaattggaattccactggtacagaaaaagacaaaaaataaaatcttttataccagagagggctgtgttacagttgcactaagctggattatccttagtattatgggtgcacttccatttttaattggcggtgttatttcaaatccaattgatgccgtatttgaaaccgtctccggttttacgactaccggtgcaagtattcttctggatgtagaatctcttccaaagtgcatgttaatgtggcgaagttttactcactggattggcggtatgggtgttctggtctttattctctgcctgcttccattaacaggaggtgacggcggttatcatgtcaacctgatgaaagccgaaagccctggaccatctgtcagtaaactcgttcctcaggttcagtctaccgccaaaattttatattcgatttatctgactttaaccgttatcgaatttgtattacttttatttggtaaaatgtctgtttttgatgcacttaccacctcatttggtacagccggaaccggtgggtttggcattaaaaatgacagtatagcgggttactcgccttatattcaatatgtagttacgatatttatgattttatttggaattaatttcagtgcttatttcctgcttttaagcaagaaactcagacaggcaatccatatggaagaagtacgctggtatctgattatcatctttgcttccattgtctttatttcttttaatgcaagagcaatgttttctactttagaagaaaccataagacatgtctcatttcaggtagcttcggttattacgacaactggttttgctacaacggactttgatttgtggccggaattttcacgtacgattctggttattttaatgtttattggcgcttgtgccggaagtaccggtggtggaatcaaggtttccagatttattttattaatcaagaccatgaaaaaagaacttcacacttacctgcatccaagaagtgtaagaaaaattcagatggatggcaaagtggtagaacacaatgtccttcgttctacgaatgtttatatgattgcctatattctgatttttgtggcctcggttttactaatcagccttgataactttgaccttaccacaaactttacagcagtttctgcaaccttaaataatatcggtccggggcttgaactggttggaccgacccagaactttagcctcttttccaatggaagcaagctgattttgatttttgatatgcttgcgggacgtctggaattgttcccacttttacttttatttgtaagagattcctggagaagattttaaccgaatgaaagaagtctccccccactgagataccaaaaagagcagatgtccatcacttctgatgaacatctgctctttttaatatcaatataatctttgttcctctttccggctcactgtcaatttcaatccttgcatcatggagaattgccccatgttttacaatcgaaagtccaagtcctgtgcctccggtcttttttgaatgactcttatctacacgatagaaccgctcaaaaatacgctcctgttcttcttttttaattccaattccattatcttcaatagaaatttgcacctgattttgattcttcttaacctttacttttacataaccaccttcatgattatatttaatcgcattatctgccacattatacatcatttcatataagatatggcgcactccatttaccattatctgtttttctgcttccacagacagcttaatctttcgtttttctgcttccacaagcaaagtcgtgccgatttcttctgccagttcactgacatctaccaattcaaacggcatgctgattccctcatccaattttgaaatctcaataatgtcctgtaccagattcgtcagtctgcttgcctcttcatagattcgtccggcaaaatcaggcactttatccggcggaaccatgttatttttcataatctccgcataaccggaaattgacattaacggtgtttttaattcatgagaaacatttgctgaaaattctttgcgaacttcttctgctttttttagttcttccaactgttgtttcaactgatgattctggtcgtcaattcttaccagcagtggtctcagttcttcatatgctacactggaaagtggttcttctaaatccaactggttaatcggtttaattaattttgaagtctgtttttcaactaataagaaggcaaatgccaaaattacaatcagcaggattcccatcaaaaaaagtccggaaaacatggcttgaaatacactgtctgtcgtttttgccacacgcaccagccgtccatcatctaatctcagggcataataaaaggtcttttttgataaagtttccgagaaacgaacggtttctccttccccttcttccatcgcctgttttacttccggacggtccttatgatttcccattgttgcagaatcttcttccgaatcatactgaacagttccgtcttcatttaatatggtaattctgctggttgtaagtgttcctgcctgttcttcccatccactgtctgtcgtctgctctaaaagcagacggacgtactgcgcttcatttcgtacgtcctgttccatccattcatttgtttttacatacatgatgacgcttgctgacacgaaggtcagcaccatcgagagaataatcataaaccctacataatttaagattctttttctcattttctgtctccaattcgatatcctacccctcggatagtctcaatcaatgctcctgattcttcgagtttttgtctcaatgtccgaatgtgtacatctactgttcgagtttctccatcaaaatcatacccccagatatgttccagcagtttatcacgagttaacacaattccctgattttccatcagataacggagcatttcaaattctttgtatgtcagctccacctgacgttctccatctaatacccggtggcgttccacatcaattgaaagatttccacagcttaaaagtgtatctttcatctgttttttgctccttctaagcactgcttttactctggagataaactccatcattccaaatggctttgtaatataatcgtctgctccactatcgagtccacgcactttatcatactctgcttctttcgcagtcaccataatcaccggaatatctctggtcttcggatctttttttaacttttcaagaatgctgtatccatcctgacccggaagcatgatatccagcagaatcaaatccggcaattctttttccagacatcggaataattcttttccttcctgaatccctattgcttcaaatcctgttgtttctaatgtatatactaacaactcacgaatatttctttcatcttctacacaataaatcatacttccacctcttctggtttttctctaccagaaaagtatacttaattttttacggaaatacaagatgggagcgcatagcgtgcccgtgcaactcgggtaacactttgaaattctacactgcttttcttcattttttccaggtatcggtgtgtatcaaaggcatcctcctgtacctgacagatacagactgccacattcgaacaatggtctgccactctctcaagacttgctgtaatatctgaaagtacaaacccctgctcaatcgtacagtttccatttctaagacgtctgacatgacggttctttaattcaatctttaattcgtcaatgacttcttcaatcggctctacgcttcttgcaatactttcatcttttgtttcaaatccttttacggcagcctcaaccacatcttctactgcttttgtaattacttttaactccgcaagtgcttcatccgagaattttagatttttctcatacagctcttttgccgagcgcatgatgctgactgcatggtcggaaattcgttcgaaatcaccgatgcagtgtaacatgatcgataagtcatggctatcctttacatttaaatctttctgactcaattttaccagataagttccaagtccatcctcatagcggtccacctgctcttcttccgctaaaacctgttctgctttttccgaatcataatgttcgataagcccaattgctgtattgattgcatcttttactttatttgccatttcaactgcaactcttcgactttgttctactgctaaagccggtttatctaagaaacggctgtccaaaagttccattccggttgcttctgtttctttcttatcttcctctttgtcacgaatcgtaagaattgcaagtttttcaagtacttttgaaaatggaagtaacaaaagggttgcaaatatattaaaagtcgtatgcacaactgcgattcctgctgcatttgctgcctgattcataaacggaaactgtacaactgcattgattgcataaaacagtaccataaagacaactgttccaataatattaaaataaagatgtaccattgctgcacgttttgcatttttctttgcaccaattgcagataataatgcagtaatacaagtaccaatgttctgacccatgataatcggaatggccgcactgtaaccgactgctcccgttacgcaaagtgcctgtaaaattccgacagatgcagaagaactctgaatcactgcggttaaaatcatacctgccagaagacctaaaatcggattggaaaattttgttaaaattccggtaaattccggtacatcagcaagtggttttactgcgccgctcatactttccataccaaacattaatactgcaaatccaatgaaaatcgttccaatatcttttttcttttcactttttgcaaacattaaaaatgcaacaccaattaatgccagtaccggtgagaatgtagtcggcttaaataactggataaaaaagttatcactctgaataccagataagcttaaaatccaggaggtaatcgtagtaccgatatttgctcccatgataacgcctactgcctgagataatttcataattccagagtttacaaaacctacaaccataactgttgtagccgatgacgattggataactgcggttaccgcagctcctaaaccaactgccttaagtggattcgaggtaagtgtctctaagattttttccatcttaccgcccgaaaccttttccagaccgtcccccatcacattcattccatataaaaacagggcaagtcctccaagtaaagtcaaaatactaaagaaatccataatttccttcctttctctttcatttgaccttattctatctatcttatgttaaattctttcgagacaaatgtaaaatctatgtaaaataataatagatgaagccatcgcacaaaagtaccctgacttcatctattgtttaaattgcctgaatgagttctgtaatcaattccttaaatcttacagacactttgtcagcagtctcctgtacttctttatgagaaagagcctgtttgctcatccctgctgccaaatttgtaatgcaggaaattccgcatacttccattccaagatgccttgctgccattgcttcacatgctgtactcattccagccgcatctgctccccagcttcttgccatccggatttccgccggtgtctcataattcggtccggtaaactgcacataaaccccttcctgaatcggaatctccagcttcttagcacaaaagattgctatttcacgcatcctttcgctgtatacttcactcatatccggaaaacgcggtcctaattcttctatattctctccaatcaacggacttggaactgctgttgtgatatggtcttttaaaagcataaaatcacctgggcggtaatcaaaattaattccccccgctgcattcgtgagaatcagcttctttgctcctaaaagtcccatcagacgaatgggcaaaaccacatcactcatcggatatccttcatagtaatgcactcttccctgcatgatgacaaccggaacgcttccaatatagccaaatacaaatcttcccttgtgtccggctactgtagataccggaaatccctcaaggtctttgtaatccacagtttctttcacttcaatgtgttctgcataatctccaagtcccgagccaagcaccagtgccacttccggtttaaaatctgtttttttcttcagactttccagacacgcaaataatttttcctttacctgatccatagattgccctccaatcatattatctaccctaaaaactacgaattgcgtcctctccatccgcttcctgaatcgagcgaatttctaccggataactcacagaatcattgacctgtactaaaacagtctccccggctttatgtccaaggattgcttttccaagcggagattctatgctgattcggttatccagagaatttccacgaatcgatgttaccaatttataagtctctgtctcatcatcctccgggaaatagatttctaccaaatcatttaatcctgcttcgtctttttttgttgtatctgttacaatctttgcagtttttaacattctttccaaatatcgaatacggctctcatttttattcttatctttttttgccgcataatactcaaagttttcgcttaaatccccttgtgctcttgcttcttttactgcctcaattgcatttttacgcacgactaattttcggtagtcaatttcttcctgtattttttttacatcactttccgtcaattgttcctgcataatcttcacctcttctatgatatcttagaatccacctgtgccagaaatcctctgcgtgccagttctgcttcaatatcatctaatgtgctttcactgtccgctaagattgtatgataatgatatcccgaagtaatatttttaagcgggcttgactgcccactttcaatttttgccacaaaatcgccaatcttctttcttgaatcaagtccaagttctgcagacagacaaccataaatcttatgattgataaatacatccgctacttttccgccacaatctacaatcagattcagctcctcctgaatttctttatccgtatggcagacataaatgacacgtgacgcaaacaccggtgtctgcagcacatatcctctatgtgttgaaagaatatcctgattttgtgcacgtaaaagtgcaacatcctgtacaattacctgacggctgacgtcaaattgttttgccagttccgtgccggaaacgggcttgggactctgcccgataaattttaagatttcttttcttctttcttcaccgttcatccttcacctcttccttcctgttacgtcttgcaacagaactctattgatttacaggatgaagatttttcatggaaatgtcaagtatcggtgcagaatgtgttaatgctccgcttgaaatataatccactccgacagaaaccagtcttgacacattttcttttgtgacattaccggaacactctgtctgtgctcgtccgtcgataattttgattgcctctctcatttcatccggtgtcatattatctaacatgataatgtctgcacctgcttccactgcttcttttaccatttcaagattttctacttcgatttcaattttacggacaaacggagcatattctttcgccatctcaattgcttttgcaacacttccggctgctccgatatggttatcttttaataaaataccatcggataagttatatctgtgattacatccaccgcctactttgaccgcatatttttcaaatacacgcatatttggtgtcgtctttctggtatcaagcagtctggtcttactaccttctaacaaatcgacaatgcttcttgtataagttgcaattccactcatacgctgtaagtaatttaacgcaactctctctccggaaagcagaacgcgaatatctccacgaaccacacccatcagctgtttattttttacgacatcaccgtcttttacataaaattcaacttcagttttttcatctaataattcaaatactcttttataaacttcaagacctgcaatgacaccgtcctgtttacagattaactgaacttctccagggcaggcttctctcatcactgcatttgttgtaatgtcctcacttgtgatatcttcttttaatgcctccataatcaaatggtctgcatttaatttcattgtaatctggttcatactgcttcttcccttaccctttcaatttcttttcttacgctttctgcatataatttctgaagttcttcttttcctaagaatttcgttgcgtctgcttttttaagcagtgcattttgtacattttcttcttcggcagtttcttttgtttctaaaatctttgtaatctgtcctgcggcacgttttgcaaataccagactttctaataaagagttacttgccagacgatttgctccgtgaactccattacagcttgtctcaccggatgcatacagacatttcatggttgtgcggctgtatttatctacttttactccacccatgaaataatgctgtgccggaacaaccggaatacattcttttgtcacatcaaagccttcttccagacatttctgataaatattcggaaaatgtgttttaatctgtgcttctccgagtggacgcatatcaagccatacataaggtttatggtcaatctccatctgttttcttatctcagctgtcatcaagtcccttggcagaacttcatttgcaaaacgttccatttttgcattgtataattttgctccctctccacgcacggattcagaaattaaaaatcttcttcctggttttggagaatacaaagtcgtcggatgaatctgaacataatccggatgttccagttcaattccatgttttaaggcaattgccaatgcatctccggttaaatgtgggaagttcgtagaatgttcatataatcctccgattccaccacaagcccatacaaccgctcttgcagtcactgcaaacaatgttttgtccgcgcttcttgccacgattccatagcactggtttttctcttccagtatatcaatcattgtggtctgtgtcaaaagttctacattagaaagtttctgtacacaggcaagcagcttacttgtaatttcttttcctgtcacatcctgatgatataaaattcttgatttagaatgtgcgccttctcttgtataagccagctctccgttttcttttttatggaattctactccgcagtcgatcagttcgttaatcacttctcttgaagaacgaatcataatatccacggattctctgcggttttcataatgaccggctttcaacgtatcttccataaaagaatcataatcctcttcatttcgctccacacagattccgccctgtgctaaaaaagaatcactgttttcaagttcatctttcgtaatcataagaatttttttgtcttttggtaaatgtaaagcggcaaataatcctgacacgcccgttcctacaattaccacatctgcttttacgtgtttcatttatttccttctcctatcccttcacattaaaattgctcagtttttgaaattatacatcttttctttacatctgacaagacagatgtaaacttgtactaaaacaagtacaaaaaaagaatcccagccaagggattctcttgtcttttttatttctgaagttttttctttcccaaccgtacttcttccatcaaatctgccatttcttcatctaaatggtcaaacagataatttttctctttcgatgtctttttttgcactttctttgaaatctctgcttctactgcttctacttcttctaaaagatttgcagcagaaagccggtttccaccctgccctaagataatcacctgttctaaggcatccgaagtggcaactgtaacctgatattttctgccaatttcatgtactgttttttcaatatactggtcggcggtttctgcttctttggtatagaccacataaatattgtggtatttcattacacttcctggattgcctttcactttataagcatcaaagaccagaatcaaagtcatttttttatacccctgataattacttaaacggtccatcagcttatttcttgcactttcaatattgatttttgaaagttcatttagatcttcccatgcaaatataatattataaccatccacaagcagatattcttttatcggttctcgttttttctcttttctggtattttctgtctcactgcttctgacacttggatttctgtttggatttctttttgaaacccgctcccagccctgtcgttctctttttactgcaccataagtacgctcaaagatggctcttagttcttcttcattttgaactccttcttttagataagcttctgcttcctggggggttctttttggcattggaatttcttcttctacctgtttttgcatcggggtctgaagttccagatgcatatagtcttctacttcataccacggcacaataaatcctgccccatgtgcacaaaagacagaaccggttggattttccaaatcactttcggaatcgtagttcatctcttcaatcacttcatccgcattatggcacggcatatagcctttcaaggtacaaaacagtctgccgtgcccacttgtataagccatcacttctttttgataatcgcgcatcaaagaaaccggtgcaaaaccagtcactacggaatattctccttcgctgtctgaaagctgaaattccccatacattttctggatatccgccatcgctcttcccactttatctgccggcagctccagtcggaattcatagaccggctctaataaaacactctttgctttttttagtccctgacgcagagcacgatacgttgcttgtctgaaatccccaccctcggtatgttttaaatgtgcccgcccgcttaccagcgtaaccttcatatctgtaatttccgaaccggttaaaactcctttatgcattcgttcttctaagtgcgtcatcaccagcctctgccagttcctgtctaataaatcttcactgcagtctgcaaagaaatgaagtcctgtgcctctttccgccggttctaattttaaatgtacctcggcataatgacgaagcggttcaaaatgtccgactccctcgacgcaatcttcaatcgtctctttatagacgatttttccactaccaaactccacttctgtctgatagcgttcccaaatcatgcgctttaagatttcaatctgtacttcacccataacctgtgcatggatttcctgtaatctctcatcccacacaatatgaagctgcggttcttcttcttccagttcttttagtttgattaacatactgtgcacattacagtcttccggcagttcgattttataggttaagaccggctctaaaaccggtaagaacgtatgggcttcgattccaagcccctgtccgcagtaagtatgggaaagtcccgccaccgcacagacacttccggctttggcttcttttactgcctcaaaagaatttccggaataaatccgaatctgttctgctttttcttcccagagttcttcttttccctctcctgcttctttttcatttgataacagcatttttacttttaaacttccgccggttatttttaaataagttaatcggtttccctgtgcatctcttgcaatcttaaagacccttgcaccaaattcttcaggataggcacatttttttgtaaaagtttcgattccttttaaaaattcttcgacaccctgaatctttaaagccgaaccaaaataacaaggaaagacttttctctttgctattaagtttatgatttcttctttctggatttctccgctttccagataatgttccaatactgcctcatcacagactgcaagattttcctttgcctcttctgtttcaagtccggcactgaaattaatgcatttctcatctaatcgttttgtcagttcttccatcagtgcattttcattggtatccggctgatccattttattgataaataaaaagaccggtatctcatactgttttaaaaggcgccataaggtctgtacatgtccctgtactccatctgctccactgataaccaaaatggcataatccaatacctgaagggttcgttccatctcagccgaaaaatccacatgtcccggagtatcaagcagggtaacctcccgctctcctaatctaaattccgcctgtttggaaaaaatagtaattccacgctccctctctaattcataagtatccaaaaatgcatcctgatgatccacacgccccagtttccgaatgctgcctgtcagatacaaaatgctttctgcaagcgttgtttttccggcatcgacatgtgccagaatcccgattgtcagtttgtttgtattctctaaatccatctatattataaacctacactttctgcatttgacttttttgtattatatcaaaaagaacgtgaaaaagcaaagcagggacaaaagccctttgataagcttctgcccctattttttgtttcattagtcaagcggatattcgcaatccgctttcgctacttgctcataaccaaatagctgctacgcagcttatcagaaggggcttgccccctcctgatacaagcaagtccccacccctgcttattgctttttgcaattaaagcaggggacttccttgatttggttaaatccttttaaaagagttttatttgctcttttttgttttgctccaaactccggagttatctaagtaataatcgccaacccatacattactcttcatagaaccatcctgttctcctccaaagtaataccatttgccgttgattttctgccagcctgttttcattgcgccatcgtttgcgcttccaaggtaataccatttaccccagattttctgccagccagtcttcattgctccgtcatctgcaccaccaaagaagtaccatttaccgttaatctgctgccagtaagttttcatggaaccatcttcagcagagccaagataataccatttaccgtaaacctgctgccatcctgtcttcattgcgccatcgttttcacttccgagataataccatttaccccagattttctgccagccggtcttcattgcgccatctgatgcatttccgaggaaataccatttgccccagattttctgccagtaagttctcatgacaccatcgtttccaaagaaataccatttaccgttaatctgctgccagtaagtcttcattgctccgtcgttttcctctccgaagtaatatttcttaccgtcgatttcctgccatcctgttttctttgtaccgtcttcgccataatagtatttctgaccattgattacctgccatcctgtcttggacagtaatgcctccattgctttttgcaggttttcttctgcagcttcgatttctgcctgtgttgcatcgtctaaatcaagcactgcttttgcagcttctaatgcctgttcaaaattatcccaggtagatgccacatagtcgtctttgtttaattcttctgctttctctactaatgctttgagttcttcaacagatggtttttcttctccaccatctactttttcaagctgtgtcattgcactttccagtccgcttactgcttcgtctacttcttcctgtgttgcagtttcatttcctgctacgctctgtgctttttcgagtgcttctgcaaaaattctccaggtttcctctgtgtagtctgctcttgttaatgcttctgctttttcaagtgcagattccagtttgctcttatctgccggattttccggttcggttggttttgcaaccagatttgccattgccgcatttaataatgcagtctggttatctacttcttcctgtgctgcattttcatctgcataaacttcttttgcagattttaatacacgttcaaagctttcaaaactttcttctgtgtaatcctcttttacttttttgtctgcctcttcaattgctgcctgtaatgcacctttgtttacttcctgtttttcaacaagattctgcattgcttctgcaagtgcagtttttactgcatcgacttctgcctgtgttgcattttcattttctgctgctttttcagctgtttctaatgcagttttgaatgtttcaaagctttctgttgtatagtctgcttcattcttttcttttgcacgttcgattaatgcatttaattctgtcttgtctgctttttcttttaatgcttccatagcagtttcaagtgcagctactgccgcatcgacttctgcctgcgttgcatcttcttttgcgtaaacttcttttgctgcatcaaatgcttctttaaatgcgttccagctctcttctgtatacgcactttcttctttctgttctgcaagaaccaaagctgcggataatgcttctttatttacagtctccggttcttctacagcataaacaccgtttactttccattcgatgataccggttcctcttgaagcatcttctgttgcgccttcacgaagctgtggtgctacagtcaggcgtactgctgttgttttaagctttccaagtgcaatggtattgtatttatctgctgcacactctaagttctgtgcatctgcaacttttacccagttaccattttcatctaaatattctacgcctgcggactgtggcaggaagttcccaccgccatcctggaagtaatacacatccatgctttcgatttcaactgctttttcccatgtgtaggaaacccatccatctataacacttccgtcttctgcatagcgattatgccagttgtgccatacaccatttgaggtatctgcggaatttgccggttctttttcgttatttaagcttgcaagaccaccaagatcatcaattctgccgtctaaaccgtcatagttgcaaagtccgtctgtttttgcatctggtgcaagattttttacctctgtatccggtttggataattcaaggtttgccattgcttctttcagattggaaagtgcttcttcaatctgttcttttgttgctatttctgattctgctacttcttttgctgtatctaacgctgtcttaaatgcgttccaggactcttctgtataaacttcctgctgtttggtttccgcttcttgaatcatttctgttaaagcagtcttgtctggagtttctgtaacttcttccagattgttctgtgctttaatcagggctgaaagtgcagtttctgcttctttcttacttgcctgtgcatcagcttcaattgcttttgcgtttgcgagtgcttttgtaaatgcagtccagctttcttctgtataagagcctgcttctaatttttcagcttctttgattgcctctgtcagctcgctcttatcaacaggcgctaacgtaccatatactttccactctacaacgcctacacctgtattatcttctgcctgtttatttaaggtgacacgaagagcagttgttgttacttcatcaaatgttgttgcattaaatttgtcaatttctaagctgtaagcacttgcatttggaatttctttccagcttccatctgcatccagatattcatatacatacgaagtcggaagattgattccaccgttatcggtttctgaaccatcataccagaagtaaatatcactgccttttaaggttacttctgaaccccaggtataagtaagagtttcgtatttacttgtgttgccccatgttccgtatcttgcgattcccggattataagatttttccggaacaagaccatcgttgataccagaaagtttttcccagccggatacaaagcttgtagaagcagttgcgctaaatgcaaggtttccatcttttgccggaagagaagcaatgactctttcgagttttgctgctgctgcatctacttcatcctgtgttgcttctttgttgtcgtaaactgcctgtgcttcttcgattgctgcacttaaagtagcatctgcaccttcttcaaataaggaagtgtcaacagattttgctttatccagtgcagattttaataactgtttgtctgctgccatttcattcgaatagccataaactttccattcaatgacaccacagcctaatgtttttggtttcatccacatacggattgcagttgttgtaaccggagcaaatgtagtcttgttgtattgattgagtttcactccaaatccgtctccattttctacttctttccagtttccatctgcatcaaggtactgatagcttaccgatgccggtgcaaaatttccatcggtaaagtagtaagcatctgttcctgtaattgttacttcgttattccatgtgtactgaacccatgcatctcctgactgatttcctccctgccagttatgccatactccatgagaagtatctcttgaacttgccggttcataaccatcatttaatccggctacgccacctaaatcctgaggtgtatttacaattgcagttggtgtcgcaatcaaagcaatgttctgctcttttccttctactacctgtactttggtagataccggataatcaattgcttctaatttaccgtttgcttcaaattcaccacgttttgtatataaggatttttcaatgtcatcccatgtgatggattcatatttgcataagccgtttgagtattctacttttgctgtctttggcatatttggtgcaactccaacggaggtaatcaccggtgaaattacaacatttttaattgtagtttctgcttcagaaccatattctttctttaattcttctgcgcttaccgctttagaaagcatcttgaagttatcataggttccgtttaaccacggagaactttcagaactggcacgaccgataaagtttttctgtgtttttccaagtttatcaaaggaaaatcctgcatctttgatttgggcatacgcttctccgttgatatataaaactgcggtattgtcttttaaggttacttctacgttctgccaggaaccagaatttaaaagcacacctgcttttacagtttctgattcatttgtttcaagatttgtcactgtcatggacagttcgtttgcgctttcaaaagatacctggaatacatttccatccatatcgccaaattcaaacagtcttgttccatttgtctgcgtaccgtttaatttcacatccatggaaatggttgcttcttttgtgttctttgtcaagtcactggaaagtttgacataaccaccgatttctccgtccatggaaataccgtttccgccatcttttccttctgcaacttctacatttcctttttgctgtgcatcaataccggaaccgctgatatcttttactttcttatttgcagtgtccatattggcagcttcaaagtcatactgtgcaagtacttccggtaaatcagattccccttctaccgtaacttttacagtatcggatgcactgttactcttgcctttggctgttaattttaaggtgtattcaccagcttttggaaagcttacttttgtggaagttgcttctgtatttgaaaagtttacttctgcttcttccggagactcttctacactccattttacagccggttctgtatgtaaccatgcattgtctcttgcatttccgtgaagcatcactgtttcgtttacagttgttgttgcatcttttcccgcatcaactacaggtgttgtgttttctaataaatctccggctttgatttctacttttgcgctgtctcctgccggaagaggaagagcgactgttgttgtaccttcgcctgcgataaagcttcctgctacttctccatttaccagtacctgataatttcctgccggaatacctgtcaggtctaggttagattcatgttctacaccagttacatttacaatgttcatggaaattgtacttccatcttttgatacggttgcgctgtcatactggtcacgatacagttctaaagaaatcttattattaatcaggtttaatctgtggtaaacaccatctaacggaacaacactgtaagaagcaccattatctttcacttcacagccatatccaaataaaccgaataccgggtcgactgcaacatcagaggaagcgatacgaactgcaccaaaaagcgcaaggtcagcttcaccagacatctgtctccagccattatgaagttttccaccgccggttccaagtgcggtatcatttcccatttctgcctgataagtccaggaaacggttccgatgttttccggatcagcatcaatctgtcctgaattgattacggtaaagttcgcaagttttcctgcataattaattctctgtgcttcacccatttcgtcactgcttaaaccattgttttcaaaacgaagccagtcatccatacaatatcctgcaagagaagcagtatactggaagttgaaccagttttcaccacagattgtggttggatttccataatgataccagattggctgtacaccacggcaggctcttgtttttttattgacttttgacataacggaatcatttccaaacatttttgccagagtgtagattgcttcttcactggtattgtcataaggatattcagaaatatatggatatgggtcatttgcaaagttctggaattttttctccatgatacttgtcaagtttgctgcttcctcttcatatccacgttcctgtaatgcttcaatgatatccggtgtagtagattctcccatcagaccagttgcccagttataaccaacggttccttcattgtataacgcatccataatgttataacaacgaagcagataagtatctgcatcttcgatataatcaattaaatccggatactgtttggcaattttatacatagcaaaataggtattgtagatatgcggatatgcaaatccacggtaagttggtgtattgttcggttcttccattaagaagtcgtgaatcaggtaatcttcctgatgttctcccatcaggttctgccagattgctacatttaaatattcatctaacgcctgtacctgctcttttaccggattgtaggagttcatttctgcaagatattcgccatgaacatatccccagtcatcaccccagccccagtaaccatcaaaagagcctctcttggacttggtatccatcatccagtcatcaaatactttatcctgaatctcacctgctgcatcccactgtgttttcaataaaaaatcagagtgcgtggacaatgctgatttcaaatcatccatcatatagaactgcagcatggttgttttttcttcgccatcctgtttgtagtttacaatgatgtcattttgtcctaaatctccaaaagcaatttcataaatatgatactgctctccattgatttcttttgtttccagatattttgcataagtgttttcgtctgtgcgttcacacgcaagattattggaaacggtatttgtaccttgatgaagattattggtatgcggacagcgatattcaaaagaaatatcctttgcatctacctttgtatgaagatacatttttgccggcatatcttttgcaaatgtcatgcccggaactgcaactgcatcaatgattccctcatcataaagttcggttttcatctcagattcatctgctactcctgtaaaattaaaggaataggttttgctttctccggcttttaaagtcatgctggaactttccatgtaacctttatttccggattttgcatctttactgattgcatcagaatgaatatagaatacattcagaccgtttgcccagtctgcctgatccatacaccattctttttcttctgcacgtctctgtcccacctgccagtggtcctgatattcaaatccggcacctgtttctgtttccggtgtcattagcaggaaatgaccctgaccactcggtcttgttgcatatacataagaggagtcttttccaacaaagctatggtcgactgtgcaggcttcataagcttctccctgattcacccagatttcatgaaatgcaagcggaactccgaaatctccaaataccaaatcagaatcattggtattttctacagtgatatcccattttaactggtcatccactaaagaataggtttctaccagtttaaaatctttaatggcacgagtgccttctgcttttgaattatcataagtcacaataattttgttatcttttaattcaaccgttcttcctgcatcagaagaattggtaagagattcactccaggaatcttcaccatcctttttggtcttgaacatcaaatctccaagccattcatgtgcaccggtgtcctgttttggattatccttcacattcatgacatagtttgtgtcaaattcgtcccccacaattttcaatgacgtgatttctccatatttaccggtctctacgtcaaagtaatcattttttaaatgatatccattttctgtcttctccgcaatcattccatctgttgctgcaagtacatcaatactgcccagatatggaagataatttccaagcaccataatcgtggaaattgcgattgagagaatcgagcgcggtacttgtttcttatccataataattcctccttcttttttcactgcctctttcagatacgcacagccttttttgtatctcttttcgcagtttgtaaaacgttttactattttctttcttagtatactctcatcgaacaatttgttcaatgtttttgtgattatattttacattttggttgttatttctaatttctaatcttattttttataggattttactataaaataacgttttacttatttttcttttcaattcattgacttaaccgaaacttctccctataataaaagaaaaataccaaaaaactacactttactttaggaggtgatttttattgcaacaataaaagaaattgcaaaggcgtgtaatgtctcaatttctaccgtatcaaatattttaaatggaaaaaacaaagccagcgatgaagtgaaaaaactggtcttggaaactgcaaaagaaatgaactatgtgccaaactatatggcaaaaaacttaaaacagaaaaatacaaaaaccattggaattattgccgaggatctcactatcttccatactccatcgattatcgacggcatcagtgaatttatggaagaaagagggtacacactcttaatgggaaatatgcggctttatcagaaatatggtaatcttttttataaagaagaaaactatgactcgcttgtcgaagatgaagtacagcagatgcttgccaaacgggtggaaggaattatttacattgaaggacactaccatgtcatggataatatttccgaactcttctccgttccgcttgttgcagtttatggtcgggtaaaaaatcctgagattacttcgattatttacgatgatgagcaaggcggttatgaagcaacaaaagaactgcttgcaaatggacatagaaaacttgggcttatcaaaggaacagaagcaagctatcatacccttgaaagaaggaaaggatttttaagagcactttatgaatatcagattccgtttaatccatcgtgggaaatctgtggagactggaataggacagacggctatgaaggtgcaaaacgtctggtcaaagaaggcgtgaccggaatctttgccatgaatgacttaatggcagcaggcgtttatgattatgcggtcaagcataatctgacgatcggaaaagacctttccgtcatcggattcgataatcgggaaatctgtgccgcatttacccctgccttatctaccatggcacttcctttaagaaaaatgggaaccattgcggcagattatttaattcaaaaaatcgaacatcccgaaccatctcatcaggatgaatataaaataccatgtgaaatcttaaaaagaaaatcggtatgcagactttagtgctctgcataccgatttttctttttttaccaatacgaattcttatttccacaccgtatctttaattccaatatcggattctttaaacaccggattctttccggcttttttctgttcttcataatttttcagtgctttaattgcagtctttctaagcagcataatcgcaataatattaatgattgccataactcccattgtgatatcggcaatattccaaactacagaaaaatctgcctgtgccccaaagaaaattgctgcaacacaggtaaggcggaaaatatttaataaagctttactgtttttaataaataaaatattggattccgcataataataatttccaaccagactgctaaacgcaaaggcaaagatggagacagtaataaaatggattccccactgtccgatgttggtacggattgcttcctgtacaaatgggattccatctaatactccactttcaccctgtacacccgaaatcaaaagcatcatagctgtagtactgcagattaaaagtgtatcaatgaaaacagaaatcacctgcaccagaccctgtttaaccggatgatcaacatctgcagatgccgctgcatttggcgcactacccataccggcttcatttgaaaacagccctctcttgattccaatcatcaccgcacttccggcaaaccctccggcaaaagaacgggcactaaatgcattttcaaaaatcataccaaatacatgcggaatactgcttatatttgtcagcatggtataaattccaattaagatgtaaacaactgccataaccggaacaataaaagaagtaatcactccgattctatgggcaccgccccagataactgctgcaaatgcaacagccagtatgataccaactatcattggtacatgagtctgcgaataattcggaatataatattctaatgcggaagacatattaaaggactgaagtccgttaaatccataggcaaagcagataatcaatgcaatggaaaacaggattccaagccagcgtttttttaatgctttttccatgtaataagatggtccacctcgaaactgtccgttttcttctaccttataaatctgagccagcgtactctcaataaaagcagacgaactgccaatcactgccataacccacatccagaaaaccgctcccggtcctcctgctgcgattgcagttgcaattccggcaatgtttccggttcctactcttgaagcagtagaaatcatcaatgcctgaaaagaagaaactgatttttctccctcatttccggttttcttttccataatggattttaatccatctttcaataaacgaacctgaactccctttgtaaatacggtaaaaaatacaccagcacccacaagcagaatcagcagaatatacgtgtacatgaaatcgtttattcctgtcaaaatctgattcatacctctctcctttcaaaatgcgtatattctgccattataccgtattttaagtttgtgtcaagtcagtactgtaaagtgaaaatacattcctgcaaaatctctaacttcttctaataattacatattattacttcttctcccactctattagatgcatcagaattaatcatacgcctgacacttacaacatctattttataacctttatttccatacaactcgtttatcaaatctgtattatgatttgtaagcatacaataacatcctctcattgttaattcatcataaagttttgccagtctcttatgactttctatatcaaatccctcttttgtgtaggattcaaacgaagtaggattcaatggcgcataaggactgtccaaaaatacaaaatctccttttcgggcatccctgcaagcatcctcaaaatctccatcaataatagttatcccctgaagatacttagaaatttctataatagaatctccgttaacagaaaccctacggctattattgtacggaacattaaataatccttttccatttacccgatacaaaccattaaaacaatgtttattcagaaaaacgaataatgccgccaattctacatcatattctgatttcattaacttatcattataatgttccctaatggtataataatactgttttccatcttcccacatctcagaatctattttatttacttcacttaaaaactcttttggactatcgcaaattctttgatacgtattaatcaacgctttattaatatcattaattaatgcttttgaaggctgtgtcccaaaaaacacagcgccacctcccacaaacggttcaaaataatgattataattttcaggtattctctcctgaatcttgcttaataactgacgttttccacctgcccatttcacaaaaggtacaatctctgtttttctcattccacttcctcttctctatgtttatatttcttttcaattatacttgcaaatagccaaaagaacaaccacagtctttactccttacttttggaatacaaaaatatattcatggttaatgcccaaaaacagattgctatctatacaaaaaaatgatagattaattattaagaataatctatttttcaaaaataaataccaggaggttttacactatggctacttgtaacaaacaacatcgttatttagaaggatttaatgaacttccagaagctcaggataacagaaacggaggacgacatatctgtgcagcttgtgcttatgaagaaggcttaaaagatgctttaaatggtaatcttcctcaatctgacctttcccatctgcctgatagtcaggctggcactgtacgccataaaagtgcaattgccgcctataaccttggatatcaatatggtaaaaaaatcagtggttaataataatattgttaaatttttaaacttcttttttaaaaaacaaaaacccccgaaagcatagctttcgagggttgatattttctctgatagataaaaattatctcttgctgaactgaaattaacgttttggtaactgggaacgcttgattttactggattcttggaatatggtgttgcaaacacgttacaaacgcaggacttctcattacgcctcaccacacctctaaattatcaaagagggagatgattcaaagtaacaaatgtgcatcttcctctttttttctcgcaatatcattcaacttcgacaatttctaatcaattttgtttaaatattattcgttgctttgttatcattgttgtattcgaaaatatatatgtactcttctgatatatttacttctttctaaaaataatttgcaaatgtgatttcaaaatttttatctaaaaatttctataattgcatgttcaacttgatgttcttttattttatcaatgattatatgcatattttctatttctaattctatttttgtatccccatcctttggtaccataccaaattttcgaaatacaaatccagtaaatgtatcacaatcttttgctgtaaatgtaacacctatagcgtcttcaatatcacttaatcgtatatttcctttcacttcccacttgttatcacttattcttataataacagtttcttcttccgacgatattggttcaatatcatttaaatcgccaacaatttcttctaataaatcaaaaagagtcactattccaaccactccaccatattcatctaatacaatagccatagattgcttcgattgtttcatatttttaaaaagcacatctgcttttgtggtttccataacaaagtatggttcagaaattgcagaatctataaccatatccttacttttttcttttaatctaaaatagtcttttgcatttaaaataccaataacatgatctatcgaatctccacagacgggataaagggtatgtcgtgtattgtggatcgtttcatcccactccttcacatcatcagacatccataatattgtcacatctgttcgatgtgtagcaatcgtaccagccataatatcattaaattcaaaaacattttgaataaactctttttcttgatgatctattgttcctttttcacttcccgcatcaacaagcatacgtatttcttcttcacctacttgatcttccgcttcatttggatcaataccacaaatcttcaagacaatattggttgatattgaaagaaatgaaacgattggcttaaataagatagagattcccgtaaccaatcctgaaattcccattgccagttcttcagattttttcattgcgattctctttggaactaattcgccaaaaaccaacgtgaaatatgataaaatcaatgtaatcaatataacagctatggtatctaaagtagaacgtggaatattcacacccatcccaacaacccaatcaactaaaggttctgagaaattatctgctgcaaaagcacttcctaaaaatcccgacaatgtgattgcaacctgaattgtcgcaagaaatcgtgccggctcttgcgttaatcgtactaatctctttgcccgaccattaccttgttctgccattcgttctagctttgtttcattcattgataaaacagcgatctctgcactcgcaaaaatcgcgtttaatataattaaaataatctgcactactaaaagaataaaaattgatgtactcataaataaaacctttctacaataaaattatctaaatatcacacttacttaaaagcaacaaaaggcatggtctatgttccgaatacatagtccatgccttgcgatatataaataaaaattctattgaattggttcgcttcagaatcattatcactttcgtccatgttaaatattcctcctctcaaatagtattgtagtacagtataacaaaaagacctaacataatcaattcgaaaaaagtaaaaattgtgttaaatttatgtaaaacataaaatccgattatttttaatttctttgggaaattcaattttctttatcatcacttaacatcattttaaagtaaaaagcaagccattttcagacttgctttccaccatatcatcttccttattgataaatcatttctttattcacaatctcccttgcacatgcttgtatatcactcattctccctatccattctaatgtatcatctgcttttagttgttctgtaattccctgtgcctgcttcatctgctctacaatcctttcaaagagttcctgtgcctgttcttttatatcagccagataatcattcaaccttccacttgtaatcagattcaaatatatacctctgcgatattctttcaaataacgtaaatgcctttgtccccatacgcctataaatctctgttcttcttcctccagcaaggtaaaacaggggataagataatccccatgtcggatataagtgccgcccatttcttcaaatattgttttcttcattgtctgttccacctcgtcttatcgttctctatccattgattttttcttaactgactgtttcggctgctgtctgccttcctgctgatagaggtgcagcttttccagtacactctcttttttcggctgttccaacgatttttctttcttctgttccgtctgatttttccatgcccttagttcttcattgtattctataatcagtccttctgctttgttataaaccttctgaaaggcttgcacattgggatagccttcacgttttactatctgttccaaactcttgtgcagacgcttttccaaatcctctaacagttcaattcgcccttccagagattttcgctctttgcctttaaatagtcctcgtaactctgacagttgctttttcaaagaagaaatatcttgctgtgtgcgttttatctctattgactgtctctgcaattcatacatgagcttctgcatatctttccattcctgcaaatcaatctttggtacaggtttaggcggtagtttaaatttgaaaattacttcctgcaaaaagtctttcgcacctcggataatctgactgaacatatccggcagccaaccgtgtgtcttgatagattgcagcgttttgtctgtgattttttcctgctttatcttcaaaatatcttcttcaggaacgccctcaactaatgccacatcaactgtccgattccattcctgccttgccgcattgtccgcctttatctcctctgctttcgaattgttctttcctattttcttggttgccagatatacgccgctctgttggaatacagagagtttttctgattcctcttttacatatcggttgatcgtatcggtaaacagttccttgacttctttggtaaaggctttattcttaaaccattcatcctttttcgtgaagatatggctttcataaacttctccttttgggataatactgcaccccgcccgaagattgccctgctcgtctaaaacctctttctttgtgagtctatgctttccctgctcatcataaaacatatttcgggtagcaacctttacttcgggttgttccaacattttccgttcactaaataccagatgaatatgataattcgtctttgccttgttgtgatgaagggcagcactgcattccacaccgtatcttttatgaaaagtctctgtcttgatttgaagaaagaaaatgtgcatttggaagaacaatattttgatgtaattgacagtaaaacagaaaacggaatccgaaaagttccgattgctgataagctcctgccttactataaagactggtataattcttgtcatgattgcgaatatcttcttcatacagaggatggcaaaagatttctttatcgcaattactatgacagctattggactcctcttgtggaacagattggaattgaccgtacaccacattgtacccgacatacctgcatttccatgttatcggaagctggtgttcaggatacaacaatcaagaaaattgtggggcactccggtgctatgactttgacagaaaaagtttatactcacttagatatgcaggttcttgtagacgcaatcaacaaaaccttagaaaatgaggacagcgtaactgccgatacaaaatctgcatagcaaaaaggacactctccagtgcctatcaccgaaaagtgtcctatattttttagatatttttgttgcaaacgtgttgcaaatgcgttgcgaactgagtaaattccaccgcttttcaccacatctgacaactccacaaacccttgtaaaacaaggatttgaacgtaaattcgagttctgaagattatctcttgctgaactgcggagcgcgacgagctgctttgagaccgtattaaacatctctatggtgcgtttttccttgatattacgggctttttcgcattttctgttgtcggttgtcctattccttaaccatggaaatcggtgatttttcatcgaaattctcctggttcaaagcatcattcactatctcgaaaagttcctctggtttattatacttgaccctcgcgtaaatgtccatagttgtcttactattctcatgccctgccaggtactgaactgtcttagggtcaacgcccgcatagagcagattcgtgatgtaggtatgccgcaacaagtgcggtgttacatcgaaattcagggtatagcgaatcttgggattgttcctctgccttgttcctaatgtcggcttgacggtatatttaatgctctgtccattcacatatttatagtaggttctctcttttgcagaacgaacaactacatactgccaaactctcgtaaactgagaataggaaagcggctgtccttcactgtcggcaatcacatactccgatatggaatttgcttttgcttcccgcagacagcccaccagacacttcggaatgggaatatcccttttagctgcctttgtctttaggacggtggagatcaccggcctgttatgctccgcgcgccatgcccgccgcacagaaatgtatggtgtggattcatccaggaatacacagtcccattgcaatgcaagaatttcttcccgacgcaagccggaatacaaaccaatcataataaaaagatatggcggaagctctttcaccgtatccagcagaattgcaacctgttgatctgttaaggcgtctttctttttcgatgcttttccgccctttgctgaaattcctacacacggattatcggttatcagctgactgcgctctgccgaataaaacacacacttaatcagcatatttaccgtatcatacagtcctttcgatttttgagatagcggaacaagcgccagacgaatatcatccgcagtcacttcctccatatacatatctcccagagagctaatgacataattcttcatattctgtctgtatccttttatagtagccgtagacacctttgctgactgcatcagcagccatttctcacaatactcggcaaccgttggatgctttcggtgaaagatgatctcatccacctgtctccgggcctccaactgcttttcatataattcttcacaggtggtcgcatataagctgacctgctttccatcggcatctgtaattctggttctgtaatacagtgttccttttcttgtaaccgttccgtactctggaacgctttgttttttcttagccatacaaatcttcctttcctgataatgagtgttcttaaattcacaccttctttttatcagaaagcactaacttaatcaaagatacggattatgaaaaacaaagagcgagacatccttgcctcgctcctgcgttgtttcctgcttttataatgttatgcctgtgctgcatcccactgggcaaatgcaccacccattgttcttaccagctcatccggtctgttgtatttgacctttgcgtaaatgtccatcgtaattttactgctctcatgtcccgccaggtattgaaccgttttcgggtctacggacgaatgaatcagattcgtaatgtatgtatgccgcagctggtgcggcgtcacttcaaaatctaagctgtaaatcacttttccgttatgtgctgccttttcaccgaggaccggcgtaaccgtgtgctttacacgctttccatcctcgtagcgataatagaaacgctccttgacagttcgggtcacaatatactgccagagccgcttgaactgcgtataggataacggatcaccgtctctgttcgacactacatattctgactgtgaattagcttttgtctctttcagacagtccgccaggcaaaccggcaacggaatatttcgatgcgcggctttcgttttcagctcatccagaatcaccggtctgttattttccgtgtgccatgccctgcgtaccgttaaataagggcaatccacatccagatatacagaatcccattttagggcaagaatttcttctcgccgcaatcctgcatacagccctaacatgacaaatacatacggcggaagtccctgaatggcatccagcagtctggcggtctgttcatctgtcaatacagctttgtccttttgcggaatgcctccgcctttggccgtaaggtaaatcgttgggttgttatcaataatcttactttcctttgctgcccggaaaatagatttatacaggataaccactgacttatataccgaagcggacttctcagaaacaggaacaagtgcaagctgaatgtcatccagtgtcacatctgccatccgcatctgccccagttcttttataatgtgccgtctgacctttgatgtataatctatcagcgtggttgccctcacatgaaccgactgcatcaaaagccatttttcacagtagtctgcaaccgtcggggatttccggcagaatgtatcgttgtcgatctgctctaatgcacccaactctttatcatataattcttccggtgttctcgcataaagggccaccagttttccatctgcgttctgaacccgcgttctataataatctatgccgttaagcgtaactgtaccgtattgtggaattgctctttttctttttgccaattccgccacctcctaagaatatactccagcgctgtatctatgttttatcaaaccattccgattccggcaaggatacggaccggctcacactccagctctgtgaggtttacgataagttgcgttcttttctgctggctttgctctgtgggtgcattttgcgatatactcctgaaggcccgctgaggtaaagtacacacagccattctgcacatattgcacataagaaataagaccattgttacgggccacgtccagcgttgcaatgctgatacctaaaatttctgctgcttcttttcgtgtaataagtttttccataaagcatatttcctccaatctgtcaagtttgtcatcgtgtttgttcaaagccacatgaatacgctagcagccgaaactgccagcgcatggtatctgattttgaacaggaagctgcaaacacttcctatttatataactcagctttcatcacatttgccacgccccctgacgatgggaacacaacaggtctccgctggcgcggctgtcataactccgcagcaccgttcatatcgtgtgccgcagggttccccccaagtctttggcgggccgtgaggaagtatctttaagcccccatgcagtcatcgcgccgaatctgccacaatccgttttatgaaatcgtagatcgctccgaagaagtcttttcatcacctccctgactgctccatcttcgcggcgtttcatattcgctcgtacatgggttatgtacctgttgtgctgtctattcgattgtcaatgtactgatgaaggaggaaaacttgtccttcttattaacactgacaaaaaaggcaaaaaacaggcgcatcaaatgaaactttatcaaaaatattttacaagctgctttaatccacggcggatactgtctcggacacggcttgggtctacaccttctacttcggcaatttcatttaccgtcattcccagatagtatcgggcataaatcctctttgcctgtttctccggcagcttcatcacagcggcatagacctgctcctgaaactgtttttcctccagaagcatctccggtgtttgcggcttcaatagcaccgcattttcaatgccattctcgcaatccagagaatactgcgctttataacgatacatctttcgctcatacgcagcctccgcacgttcagctgctcgaatagtctccattacttcctctgtcacatctacaaaaaagtctgttgtataaacatcaggataaagttcccgaaggttaattttcttcattatgtacctccatttcgattcacgggtgattgacgggtgaatcgaatggaggcggagaccgacactggcagacaaccgggtcatctccgaaaaaatggcaacaaaaaacgccagatttccgtgagggaaaactgacgcgccaagaacagccattattatactgaattacatggaacgataatgccgatgcaatgttatacttgcccggaggaggagcaatgctttttttaactggtgtagatcatggatactgcaaaaaggcaaaaaggacacggcgatacctcctcggacaccgccgtatccttaaaaaagggcgactttatcacaccccccgcaaatccaatttttcaaaaggaaaacggcggcttgaaatgcaatatttcaaaaccgccattctgcgccgcaaggccgaattcaacggtcttgttatgtctgccaacacagttgctaccaaaaagaaaagagccgataaaccgtttgcctattggctacgggttatcggctctgcgtctgtgcgtctggctcttttacaatcgaaatattcaaattttgtgcggtaataagtgtttcttgcttacacttaggacaatacagaggaaaatttatgagtattgtatctcctctgatttttaagcgtgttttattacggcatacaggacataatacccattgaatttctggcaagcgtttgccctccaatctactttttcttgttcttcttccaaactttatataaagcgttcaagataggaagtaaaacgcatattacaacaaaccattctggaaaatgtggcatattacacctcctcgttctatgctaaatgaaatactcctactacaatgcaaacaactgtaacaaataaggatacaagtattctcgctaatgaatagctatataatctttcaggatgttgcaaatcatagcgaacagtcacagagttacccacttgggctgtcaaggggacttgtatgcgatttcctgaaacataggttttcccatccacccgataggtgacttttgcccactttgaattgcgagtctttgccgtttcgggattgggcgaagtaattgagttgatggttcctgttgttttcccagttatatttctttttgcccaaaaggcaagtgcgttgtaaagagcaaaaagaaaagagactgacgcaattaaatataaaaagatcgtgtcgtttttcattttcgttcacctccaatcaacaaaggcgctatgataagtcagccttacagtacaccttaaccgatattccagcagacaccgccaatacaataactccaatcaaaatagctccggcagacaagatgcttggcgatagagcaattaagggataccaatttgcgccaccctgcattttcagtaattgcggcacaataaaaggagaagccataataatgataaagaacgcaaattttgtcgtttcatatcccaacttatattgtactgggaggtaaataccaaggaacagagccacaacgaggaacataaccgctgacagttcaatgtgaaatccaccgagaacagggaataacaatgtctctgcccagaaaatcaaacagcaagcgccataaatcagcaagccaaaaacatatttagaaagtacaagtagtttgcggggatatggtgtagcacaaagtagtgtggacgcttttgcgtattggttctccttcaatgaaacatactgcaatagcataaaaacagaaaaaattgcagctaagataaagctcatagaaccaacataagttgcgtcgtctattcgccacatcataaacggcggtataaaaacacagaccgctaacataagcaaaacatacttcttcacgataagaaaatcttttctaactagatggattagcattatttttttcctccttcaatacttcccaacataatgtcctcaatcgttggccgttccaccactacatcaggaataagtcgttgcacctcagaaatctttttagtgataccggaaaaaccaaatgccgtttccgtagtgcttaaaaataatttacgggtttctgcatttagataacgcacatccccttttacaatccgatagtagtccagcagagtatctttttcttcctgaaatacgatgtgaccattatcaatcataattagcatatctgcgattttgtccaaatcagatgtaatatgtgtagagaagaaaacaccctttccgccactattcatgtaatcggtaagtatagttaatagctggcttcggatcaaagggtcaaggccgctggtaggttcatccataatcagaagttctgctttatgagacagcgccagtgccaacgcatatttcattttcatgccttttgaaagcgtattgattttctgttttgggtttaggttgaaccgttccagatagtttttgaagtcttgttcacaccacgatgtataggccggagagataatacttttcatttcagctaaagataattcttcataaaaatagccatcatcaagaacaacgccgatgcgatttttaatttcctgctcatgactttgcatatccaatccaaaaaattcaatatgcccagaagttcgattagtaagctctaaaatcgtccgtaaagtggttgtttttcccgcgccgttcaccccaataaatccagtaatgcacccctcaggcaaagaaaagctgacattacttaaagaaaaattaccgtatgatttgttcaaatcggaaactttcaaaattgattccatttcaatcctcctcgtataatatatccatcatagaattaagctcgtctttgctgatattaagtgattttgcagtctgtatcatatccagcattttttgctccacaagccgtcgttttgaatcacggagcaaatcaagattgctggtagaaacaaatgtgccaattcctacctgactggtaacaaagccctcttgctctaattcttcataaacccgcctaatggttaaaacactaaccttcaaatcatttgcaaaggcccgtattgacggtaacgcatcgccctcttttaattcttctttcaaaattgcgtctttgatttgctctttaatctgttcgtaaagaggggaatcagaggcgtttgatattagtatcttcacaagttcattatacctcctgtatggtgtgctgttgctatatacacactatacactataatcactttcctgtcaaccacgcccgaaaggacaataaaatactactaaaacataaaatttagtttcgttctcataatcagacccgaaatgtacaatgatatagggtgatatgagaatgaaccaagatgaaagaaggtttgactttcatgggctcgggctcgctttgaaacaggccagagaggaaaagtgtttttggcaaagctactgcttgaaaaaccagatgtattgctattagatgagccgacaaattttcttgataaagatcatgtttcttcactcaaagatagctttacaaaatacacctctaaggctactacaataggtagggcgcaaggtcttatgcagaagcactttgagaccttgcgccctctgttattctaccctaaaaatactttgccagctgcttcagaccacgccggatgctgtcacggacacggcttggatctacaccttctacttcggcaatttcatttaccgtaattcccagatagtatcgggcataaatcctctttgcctgtttctccggcagcttcatcacagcggcatagacctgctcctgaaactgtttttcctccagaagcatctccggtgtttgcggcttcaatagcaccgcattttcaatgccattcccgcaatccagagaatactgcgctttataacgatacatctttcgctcatacgcagcctccgcacgttcagctgctcgaatagtctccattacttcctctgtcacatctacaaaaaagtctgttgtataaacatcaggataaagttcccgaaggttaattttcttcattatgtacctccatttcgattcacgggtgattgacgggtgaatcgaatggaggcggagaccgacactggcagacaaccgggtcatctccgaaaaaatggcaacaaaaaacgccagatttccgtgagggaaaactgacgcgccaagaacagccattattatactgaattacatggaatgataatgccgatgcaatgttatacttgcccggaggaggagcaatgctttttttaactgatgtagattatgtgagctttgaaaaagcaaacgagacacggcaaaataacctccaatcggctaccgtgtccctgcaagtcgtcataggattgtgtaaacgcaaagaaacggcggctctgaaatcaaagccgccgtttcaaatgggcgtgtcaaattgtctgctctacgacggctttttttcttttgccgtcgtccggcagattttctcttttaaggaaatatttatgaagttctatgatacagcaagatccaataagtctactcactttttattgctgataaaatactcgcttttttcaattccattttggaatacatcgaaaaaacaaggtatatcaccaataatacacaaatcagtgccaacaggaaaaaccacggtaatttcaacgtaatacaatgattgatggcatctaatcgtctgcatacaattacactaaaaatacttccgcatataagagatattgccaatgaacctccgaggtaaattccaatctccctattcagcattgctttcaactgttttcgcgttaccccaacagcttccaacagaccgaattcacgctttctattctgaaaatcaaccataagcatattcataagactgatacttccaaagacgaacagaatagcagaagtcatatatagagcatttatagatgcactgtatcgatgctgaatatttttaatcgtttgttcaatcgtatttacttctattttttcatttttatccgcaatcttctgaactgcggtcaaaacttcatcaaaacatccctctgaatttttaatcgccagaatccccgtctgttccgttatccctgtcagtttctttgctgtgtcataagtcataatgaagtaggggcttccaggaacaaccgggctatcctccattaaatcagatctattgtatgtgcctacaacaacggcttccacatcaaaggttctaccatcaaaagctctgccctcaatcttcaaagtatcgccaacttgtgctatatcttctgcaaccaatattccatttttctcaaccatatcatcgtaatctgctgttccagaggataacgccgcctgcttttcttctgtctgttcccgatttaaggttggaaagaagtctgaaatgctcgtgatagaaccactttcgcccgaaaaagtagctgtcatataaacgctgtcaaatgcggtaatcttttctatcccatctaccttttctaattcctgcatcaatgcctgatcttcaagtggattttcttccagttgcaattttgcacttccgtatggctccgcttcgttatcgaaagagctgccaactgtatttcttatttgtataagaatgttaccggcaggataatatttgaaacttgcctgttttgccggatcaatagaaccagcaaccgtagaagtaaccagtaaaagagctccgcttactccaagcattaaaagcgtcagaactgctttttgtttgtttctttgtatatttattttcgccagattaaacggcgtaagtttccgatgcagttttgagctgctttttgcctttccagcatacgcaaggtatttagcaccctctaccggggaagtattcattgctactcggacaggcttaaaaatggcaatattcactgttacaaaggctactgcggcaatcagtacagcataaataactgttgtttttagccggaatccatcaggacagccaataaatccaatcagtacaccaatgacaagccccaaaggaataccagctaaggcatataaacgtccctctttacttgccatccgtttaatctgtctttttgtcatgccaactgtccgcagttgcccaaacatctgaacattttttacaatctttgtgtaaaaaacaccatagacaatcgttgccgccaaaatagccgtcaacgccgccagtagtggtactggaatcggaatacccgatgttatcacacccgacataacagcagaatactctgtaagcattacctgttcctcgacaatgcctgtattttgtattgctttgccggcaaaattaagaatagccgtggaacttatggcgtctgtattcaaccgcgtatatgctgtaacctgaaaagaatcttttgccaaatcttgggcaagctctttactaacataaataaaatatccgttgctttctttcgtattattcaaaacacctgaaagtgtatattctgctttctgtcctgttccagtcaggtcaatagaaattgtatcgccagtctgataggattttcctaaaaaatcaaggtagttctgggggagcataatctcatccgctttctgcggcacacttccctgaaaagttttttcttcctgatgtaaaaaataatcttcatttccataagcaacagtgattgttttattttcaacataaaacacacctatagcggaatattcgccaacccatgtaatattttcgttttgatgcagctgagccgtttgttcgtctgtaactcccaaaatgccaatctgcgctttattcctctgtgtgttcttgaatttctcttgtgtacctgttgatattaggagaatcgaaaaaaccatacagacagagatggcgattgtcaaaagcagaaatgccttgtttctcttatccgcttgcatactcctacctgccaatttttttacaatggcacttgtatcattttcaaaaggccatgtcatagtctgccacctccttactccacaatcttgccatcctcaatgcggacaatccgatctgcaaggcgggctatgtcgttattgtgggtaatcatcacaacagtctgccggaactccgcacttgtgcgcttgataagccccagcacctcggcgctggtcttgctgtcaaggttgccggtcggctcgtcggccagcacgatagccggtttggtaatcagggcgcgggcaatcgccacacgctgctgctggccgccggaaagattgttaggcatatttttcagtttatcttccagccccagcaggtgaacgatctcgtccaaaaacttctgatccaccgtgtccccgtctaactccaccggcaggacgatgttctcatacacattcaggatgggaacaaggttatagttctggaagataaagccgatgttgcggcggcggaagatggtaagctgctcgtcgttcatttttgacagctctttgtcccggacaatgacattgccggaagtaggggtgtccagcccgcccatcatgtgaagcagggtagacttgccgctgccggaggttcccacaacagccacaaactcgccgtcctccacggagaagttcacgccgtcaagggcgcgggtgatgttcggctctgtgccgtaatactttttcagatcaatcgtctgtaaaacgctcatactcaaaactcctttcaaggctttctgcctgttgataagggtattgtaaaacccaaatgtccgcgaaatgttacagcggccaaaaaatttcattgaaaatcagggtgaaatgttacaacgctcggacatttcaaaaaaatttacggcggcagccggaaatggccgtccgccgcgttctattttgtaggcagcataatggaaaattccgaacccttgcccggctccgaaaccactttgatataaccgccctgtcgcgttacgatctcgcgagccagatataggccaatgcccacgccctgctgttcgtgtacttcttcctcacgatagaagcgccggaagatggcggcctgattgctttcagaaatgcccttgccggtgtcggtcactttgatctccacatacatttcccacagcaccaccaacacagcgattttcccgcctgccggggtgtacttcaccgcattgtccagcaggttaaagagggcttcggatgtccacttgctgtcatgggaaacggtcaaatcctccgggcagtccacggacacggcaatttcctttttctccgctgcatacacgatcccactcatggcctgcgccacagtatcaaagaggcggcccggtttcttgttcaactggatcacgcccgtttccagccgggaggttttcacaagggcctgaaagagaaagtccagcttatccgtctggctgcggattccccggataaagtcggtgcgctccgcctcggtcatgggcttttccagcagggtgtccgtcgccattttcagattgcttaccggcgttttcacttgatgggaaatatccgatacaagggtctgtaactcctgccgttcctcgtccacccggcggcggttctcctgcatgatctggtaaagccttgccagccggtgcccgattctggcaagctgggtttcgctgtcctccgggcgctggggcgcttcatttccagcgatcatgtggtctaaagtctggcacaggtcagcggtaaactgcgatagccgctttccaaaggtctgcgttaatacgaaaatccccacaagggcgcacaacagcagcgccccgcccgtcagcagcaccgcaatctgttttgtcacaagaaacagggctatggtgatcccggacatggagaggacaagccccattgccacccggccaaacagccgctttaccgagaggttttgaaacttcattttgcctcgcctcccgtccattgatagcccatgccgtaaacggtcttgatgtagggggcacctccgtcggattcaatcttgctgcgaatccgactgatggaggttgtcagggtgtgttcgtccacatacttctcgtctatatcccacagcttttccaaaagctgtccacgagtcagcacttgccggggatttttgcgaaacaggttcagcattttgtactccatcggggatagagtcagaggctttccatttaaggaagccgtctgctctgaaaagtccagaaacagccgtccatcgtcgtaaatgtctttagctggtttgtggtgttccagcatggcgaacatggctttgatttttcgctgcaaggctctgagcacaaagggctttgtgatgtaatccaccgcgcccacctcataaccccgtatctggtcgctctcctgatcgttggcggtcaggaaaattatgatggtgtccgggtgctggggctttattagcctgcacagttcaaaaccgttgccgtccggcaggttgacgtccagcagaactaaatcaaactcccgttggcggatggcatcggctgcggttctggcgtttagggcagaagtcacgccatagccatctgcggtcaggttataagtcaacatcttattcaaaaaactgtcgtcctcgacaattaaaatctgcttcatatcctcacttcctttgctttttgcagatagtataacaggcaaatgtccgcgaaatgttacagcggacggattttttcaaaaaaatttccatctatattataagttgatccagttagtgatacaaggatggtattcaggtctttattaaaaaccggcataatcaaacctatcaaccggtataataaggttattcctttgtgcaaatcggcacgatagaatatacttgaggtggatgattatgccgattgatgatttaactgctttagggcagaaaatgagaggggccagaaagaataaagaactgacacaacaggaactttccgatctaagccatgtttctgtaaagcaaattgccaatatcgaaaaagggaaaatgaacccgtcctatttgattttgagagcattggcaaaagtcctgcacatctctttagatacgcttataaatccagatatttctctggaggatgagggtgtcaatcagatgaaaatgctttattccagctgtccgccagaaatgcgtgacaccctgttgcatcacacccaggaaacggtgaaagagctaacagagttgtccgagaaatttgaaatgaattgagccagtgagtgaaatttaacgattctctcactggttcttttcattttcggagaaaagaggcaagcaatgcctgtgttaatacacacaggcccgcagagaagaaaatccctccgtgattttcctctccgcttgcttgttgagggcagcgcccccaagcccctttgaacacagaatttcattctgtggctacgcgttctgcgaacgcttttgaccaggaccagcttaccgctggccgtggtctttttctttttcaacatcctgttctacctccattttcagcacccgatccacattggcctttgccgttaaaagctccctcatttcttcacgggagcgccgatactcggaataagtctttttcttttcttccagcaattttgcgtactctgtctgtaactctttgacctttggcagcttcttgactcccatctcatcaaaggcattcttagcagcctggtggagcagaatttcttcctcatgttcttcccggaatttcttagaataacccgccttgcggtatgccacatagacctcacgggtcttggcataatttacgatgtgagtacgcagaacagcggtctctgccatgcacttttcagccgctttgatctgcgccgaaagatcattgtgatgtgccgtggcagccgtagccttttcttccaaaaccgcatactccagcagattgttctctgacaggtaattcatggtctgcgccatttgtttcagattaaaaactttagcccatcgagcatagccagcaccttttccagcctgcaattttgcctgaatgtccaccagcagattgaccttcggcggctccggctgcacgacagattttttacggggcgtatgctgtttttcaccggccagcaccgcacggatttctgcttcactgtacccggcccccagcttgtcatccatgcgggctacattcttccggccgggagctttgagccggatcgctttcccgcgccgggatacttcacagcccatttccgaaagcagcttcagcagcgcatcaaagtccgctggattctgctccagcgcacggtcaatcatcacccgcagctgctcccgatgggagggcttggcctgatcgcccagccatttgttgtagctttttccgtggggcttgggattctccacaatggacagtccgttctcgatacagatggtatcgctcaagcgccggacggctctggtgctgccccaaaagtttcggaacttccggtcatattctaagctgaccgatgaccagataatgtgattatgaacgtgggctttgtctatatgagtgcagaccacaaaggcatgattgcctttagtaaaacgctttgcaaattctacgcccagccggtttgcttcttccggggtaatctcaccagggcggaaggactggcgcacatgataggcaatcacatcatctgcgccacgcactcgtccagtagcggcaatgtactgccgctttgccagaaggaactccgcatccgcagtccggctgtcacacgcatagccggtaatgagcttgccgttatctgttttctgtggatttgctacatagtcgatgatgtcactgattgcccgactttctgtgcgacccttaccaacatgaagcggcatgattcttgtagttgccataatagaaggccctcctctcataaatattttttcgctgaactctttgcttctatcgttgcaataactttctccgctgggtataataaaaaagaacattctacaacctcaagggagggattttatgatagaacagctcattgccgaagcaacggaatgtgatttcaaagttgctctcgaaacaaaaaagccaaaaagctggttaaaaagtgtcagtgccttttccaatgggatcggcggcactctgtttttcggagtctctgatgaccgggagcctatcggcttgtccgatgttcaaaaggatgctgaagcgatcagccgcttaatcaaagaacgtatcacaccattaccgcagtttatcttaaagccattgcaggaagatggtaaaaacctgttggctctggaggtttctcctggccgcagcaccccatactattacaaggcagacggcgtgatggaggcatacatccgtgttggaaatgaaagcgtaattgcaccggattacattgtgaatgaactgatcttaaagggaaccaatcagtcctttgacaccttaacaacagaagctgtgaaaaaggattacagcttcacactcctggaggcaacctatctggaacgaaccggcctccgcttcgagccatccgattatgtctccttcggtttggctgacaaaaatgggttcttgaccaatgccggaaagctcatgaccgatcagcacacagtttataactcccgtatgttctgtacccggtggaatggcttggaaaaaggctctatctttgatgatgcgctggacgataaggaatacgaggggaatttgatttatttactgaaaagcggcagtgaatttattcgcaataattccaaagtccgttttgtcaaagaagctcagtatcgggtagacaagccggattatgctgaacgagctgtaacagaggctcttgtcaacgctctcatccatcgtgattatattgtgcttggcagcgaagtccacattgatatgtttgatgatcgggtggaaatcacatctccgggcggtatgtttggcggcggctcaattcaggaatacgatatttacagtattcgttcgatgcgacgaaaccctgtgatcgctgacctgttccaccgcatgaagtacatggaacgccgtggaagtggtctgcgcaaaatcgtcagtgaaactgaaaagctgcctggatacacagaggcatataagcccgaattttcctcaacagcgacagatttcagagtcatcttgaaaaatgtaaattaccatcatggtccttctatcatagaaacgacccatgataagacctatgacgcaacccatgatgcaacccatgataaaatccttgcattttgcatagaaccacattcaaaattagaaatcgcagaacactgtggatacaaaaacacaaaaaactttacacaaaaatatctgcgtccgctattgaacaatggaacacttaaaatgacacttcccgataaaccgaaaagtaaacatcaaaaatatattacagttcgttccgaataaacagagaagcagggcagtgggtctcatctcccattgtcctgcttcttttcattccaaattatattcacatcatttacccatacacccaatcctggatcgcaaatttcaaactctgcaccttgctcagcagccagatcgcagccagcggcagccccatcgggctaatcaaaaatgccataaccagcaaaatcacaccattctgcgaggaataggtaatcagcacagccacgccaagcagagcaattaccgtgcttagtagaccaagcaccagaccggatatgtagatcagccccgtgcagagccagacaaaaagcgtcaacaccaaaatgaccggtgcagttacgatcatcagcagacatttcaaaatcttcatttctgttcctccttccaacgctccagatactgtttgcatagggcatccgcttctctctcatcatcttccgtcacttcccgttttcctttggtcagttcaatctccagataagtccggtaatcatcagctaagagatcgaacagttccttgggagtatggcacacctcgccagagcaatagtgaaaatcttggtcaaattcaactcttacacatccatggcggctgatataaacttctatggtctcgtctgcggttaggtaatccgcaaaaatctccagcaccttttcaaaggtcagcatctgttttcactcctttgctacgcttcttattctactcatattatccggtacggacaggcaaaagacaaggatacagacaaaaagaaaaagcggaggaaggtgcggcgaagaaacgccgttcctccctccgcaaatggagtatctacccctgttatgaaagtttggagagttgggtaaggatttccttcacaccctcccacagttgttcctgccgctgggatatatcctccaagtcagcattataaacccgcccggtctcatgcactttgcgggtcagctggttcaagttgttgctgcttcggcgcatcagggagaccagctccttcagctctggcagttccagcttgaccacataaccatccagcgccattttccgcagataagcgctcaaattctctgtcccgtattgctgcatcttttgatggatcagttccagttcttctgcggacacccaaaacaaaaccggcacatcccgcttgcgctttgccatggttatcgctccggctcccgttttttcggggtggcaggcttgcgggcaggcggttcctgcttgagcttttgcaggacagagcttttctgctgttcttgagcgacttttcggaactgtctggtgaacaggtcggtcaaaccgggattgacctgatctaccaccagataggcacagtggcgggaagcgccgctgtcctccagcgtaggaatgctttttgcccatgctttattgtcctgagagatacgcccgtcatggttcttgtgctggatggtgttggcaagaataaactgtacccgttccgtcccgaacttttccagcacatctttgaccgcagcctccgtatccagccgattctctgcatagtgggcgctgatggtctgctcaatggtttctttgcaggcgctgttcgcctgatatgagaggttgtactgtgccatttccccatgctcggacgcataggcagcagaatatggatagaccggtgctgttcgcagttcctctttggctctgcacacatcgtcggcacggctttcaatgctgtcccggatcacacccatatagccggtctccagcttttcaaaatagcggtacacatccgtcaatggagagggagattccaaaagtgcctgagcctgggtgtcggtcaactccagttcctccattgccatcacgatgtcctcgcggatggtgtactcataggcatggtttaagacttcttccgggggctggcttttcagccagtcccggaacttgtcctgttcggcagccatcttttcataaagagctgtattcagatcgttagtattcatgttatcgcacctcctcatgctgttttggtttcttgtctgtactgcggggttgcaccgggcgttttaggttatccagcaccgaaggccgtgtgcttttggcaacaacagactcggtgtgtgcctgcccctttccgtcgatgttgagcagggtatccagctccaccagacgggcgtttttgcttctcagttcttcttcataaaggaatggctttccgacttcctcctttgcggcagcctgctgctgatagaggttatccagctgggcctttgccgcctccagacgctggggcatctgggcgagggcattgtcgatacgggtaagatttccgcgagggtctgtaccaagggttgcccggtgggtcatctgtcctttcagcaggagcgtatactcctgtttccaagcggaaaattccacggacatggcataaccccggtagctgccgatctgcaccggatcggaggttttgacctccttgcaggcatccaaaagggctgcaccggcgttctccttatcggtcagcaggtctccacgaatctccataccagcaaaaccgtcctccgggtgcgggtgagctgtcaagacctccagatcggattcaaagcccttgataaaacccttgtgcttttcaatctcctccgggaagtatttgagcagctggtcctccagacgatattgcttgctctggtggtcggctttcatcagcttcaggcgggatacctccacatccaaatccatacgctccttgatgcggggatctccggcacacagagccttgatctcggcaaaactgagggctgtttcatccacatcatcgcaggaacgcaccggcgatttagaagtcatgatctgactgatgaatttctgcttgttctccactgtctgccagaggtatgcgtcaaaggttccctcggtcacatagcggtacacatgaacaagggggttctggttaccctggcgctcgatacggcccttgcgctgggcaaggtctccgggtctccacggacaatccaggtcatgaagtgccaccagacggtcctgcacattggtgcctgcgcccatctttgcggtgctgcccaaaaggacacgaacctgaccggtacggaccttagagaacagctcctttttccgcacttcggtattggcttcatggataaaagcgatctggtcggcaggcattccctgagcaatgagtttctgacgaatatcgtcatataccgtaaagaccggttcctgctccggcagaggcacagagccttccaatgcgtgaagcagtggattatccagcgttttcgccgccttgcttacaggagcttttgcctgcggtgtagaaatgtcgcagaacaccagttgggtcagcttgtcagctttgccatcccgccagatctgcatgatgttgtccacgcactgattgacctttgtgccaggttcatccggcagcatctggttgacgattctctggtccaggcccagcttacggccatccgaggtaatcttgagcatattgtcctgggacgggtcaacggttccgctgtgtaccagcgatgcgcgctccgaaagggccttgaccatttcctgctgatgttcggtgggctgcgccacgatgttgtggtattccacctccggggtgggcaggttcagttggtcggcagtcttgatgtccgccacttctttgaacaggttcatcagctctggcaggttaaagaacttggaaaaccttgttcttgcccggtagccggttccttccggtgccagctccaatgctgtgacggtctctccaaatcgggaagcccagcagtcgaagtgggtcatgttcagttcttgcaggcgttcatactgaaggtaacgctgcatggtgtaaagctcggtcatggagttgctgaccggtgtgccggtggcaaaaatcacgccacggtttccggtgatctcatccatatagcggcacttggcaaacatatcggaggatttctgcgcgtccgatgtggaaagaccagccacattccgcatttttgtgtatagaaacaggtttttatagttgtgggcctcgtccacaaacaaacggtccacacccagctgctcaaaagtcaccacatcgtcttttcgtccctcggcttgcagcttttccagtctggcttccagagactttctggtacgctccagctgcttgacggtaaaacgctcgccgccactggcctgtacctctgcaatcccctcagtgatctcgtcgatctgttcatagagaagccgttcctgacgctcccggctgatggggatacgctcaaactggctatgtcccatgatgatggcatcataatcacccgtcgcaatacgagcgcagaacttctttcggttatgggtctcaaagtcctttttggtggtgactaagatattggcggaaggatagagacgcagaaactccgacgcccactgctcggtcaggtgatttggaaccacaaagagagatttctggcacaagcccaggcgtttggcttccatcgaagcagctaccatctcaaaagttttgcctgcgcctacttcatgtgccaacagggtatttcctccatacagcacatgggcgatggcgcttttctggtgttcccgcagggtaatggccgggttcatgcccccaaaagtgatatggctgccatcatactcgcggggacgggtagagttcatttcttcgttgtactggcgcaccaaagtctggcggcgctccgggtctctccagatccagtccctaaaggcttcccggatagcttgctgtttttgggcagccagggtggtctccttggcgttcagcacgcggcgctcttttccgtctgcgtcctctatggtgtcgtagatacggacatcccgcaggttcaggctgtcctccaaaatcttgtaggcattggcacggctggttccataggtagtgtaagctgccacatcgttgtaggatacagaagatttccccttgatctgccattcagcagtaaaggaggaatagttgacctcaatgctgcgctggagataaaacggggtgttgaaggtctcgtacataaactgctggatatactccttgtcaatccaggtagcgcccagacgcacctcaatttccgacgcatccaggtctttgggctgggcggcggtaagagcttccacattgactgcataaaccggggcctgctgtgctgcccgctgtgcctgacgcagcttgcggcgcacattcccggacaggtattcgtcggcagtcacataatggggcgatccgtcctgttccagctgtcccggtacacggaagatcacaccttgcagttctccctccagttctgcttttgtttttccgctaagctggctcatatagctcatatccacgcaggctttttccgagatggacaccgccagtgcttcacttgccgtatccaccacagccaccgcctgatggggcttgatggtccgcttggtgaacatatccgccttgcgctccagctttccgtcctcgtcgatgacttccagcgcacagagcaggtaataggaagaatcatctgcataggccagccgatttgcacggtcattgataaggccatattttgcagaaaagctgtcatagaggctgttcagttccgcctgcttttgggtaatggtgctgtctggaaccgctgcatccatctgaaggtcgatcagttcctgcacacaatcacgcagtcccacaagacctttcacacgggcttcggcggtggcgttgaggtcagggcgcaccatgcggctgttttcccgatagaacacctgcccgtctacaatggcataagaatagttcttcacattaggatcggcaggaatggaggtgccaatggcttcgccttcgcccagctccggcagctctgcctcctgataagtgccatgaatatacttcaccgcatcatgcagctggtcggaaagctccagtccctcgatagggttcacggtgtagtccataccatgagcagtgcttaccggctcctgtctgcccagcaccatttccgggtggtcgataaaataccggttgatggcaaatccgtcctccgtctgtccggtctgggtccactctggtgcaatgtccagcgggcggtcccgcttttggagaaagatgatgtccgatacaacctcggcaccggcattctttttgaacgcgtcattaggcagacggatcgctcccagcagctcggtacgctgggcaagatagcggcgcacggtggaatccttggcgtccatggtatatcgagaggtcacaaaagctaccacaccgccgggacgcacctggtcgagtgctttggcaaaaaaatagttatgaatactgaaattcagcttgttgtaggctttgtcattgacctgatactgaccgaacggcacattgccgatggcaaggtcaaagaagtcacgcctgtctgtggtctcaaagccgcctactgtgatgtccgccttgggatagagctgctttgcgatgcgcccggaaaccgggtccagctccacaccgtacaaatggctgtttcgcattttctccggcagcataccaaagaaattgcccacacccatagacggctccagaatatttccggtctcaaatcccatacggtccaccgcttcatagatggcctgaatgaccgtagggctggtgtaatgggcgtttaaggtggagcctctggcggcggcatattcctccgtggtcagcagctctttcagctgggcatactctaaagcccatgccggtttctccgggtcaaaggcatcagagagaccgccccagcccacgtatcgagaaagaacctcctgctgttcggggcttgcctgctgtccggcagcttccagctctttcagcaaacgaatcgcattgacatttgcctggaacttggctttcggaccgccttcgcccaaatgctcatcggtaatgcggaagttttttgcattgcggcgcaggttagccttgtattcctcataagatgcttcctcggcagctttggcattgggaaaggtctgccactggccattgacctgaatggaaaccgggtgttcatccaacacttcctcaaaggttttctccggctcagtcacaggggctggtggctccggctcctcgatatgcagtcgttccaccaccacatcataaggcagattgttcttatcgcccggatagacggccacagtctcggaatggaaggccggggattcggcagccggttggggctgttcctgtccaaaaccgtcctgctgacgggcatacatcccgcgcagcaaaggcgcaacctcatcccagcggaaatacagcatagccagacgcttttcctctgcatccatgacttccagttctatgccctgtgccgtggtacggtaatcggcaatatcgccggtctccagattcagtgtctcgatctcaccggaataggctctgctcagccagtaggcgatctcgctgttgctcctgccggattgcagcagcgtggaaatctgctttttatccgcttcatccatcagtccatgagccaatacataccgcaagtcctgatctgccttgtccgggtcagtaggaagaaactcggtatagtaagcattgcggcggtctgcccgaagcagctgctcgaactgttctttgcgctctgcccggtagatgggatataccatcccggtgggcagaagctgtacggtgtcctcccgcagctcggtgatctgataggcgtcatcctcgatatacacggtatcgcccacggcatagaccggggcagcagggtcataggatgttctttgcggaattgggcggcgaactgcatcatattcctcatcggaaatagcaacttcggaagtctgctctgtctcggcagctgcaatctgctctacatccgacatcacctgttggataaacgagtcattgtccagtttttccgagtctgccacctggccgttgacgatccctctttcctccagggcttcccggatggcgatagggtcgatattgtcaaaacgatcctgttcttcttcggtatagaaccggtcctcctgaataagctgggcaagcctgcgctgtaccttcggccagggcagctgtgtttcctccgggcttccgacacggacaacgaacgggctgttgctgccaccgtattcctgagccagccatacagcggtatctttttcccttgcatggtctttcatataacggacaacagcgtgtttactctcgatattgccgttccatgcacaaagggcagtatcaatatcttcctgagaaagagggcgcagaagttcatggagcttttgataggtttcgtcgatcacttcccggtgcagacgctggcggaactccggtatatcagaataaaggcggatcagttccatatccttagaaccaaggaccgcacggcgcacagcggcattgccctcgatgacagcattttcacggtcagaatgaccgcaggcattgcggtatgctgcatcctcggaaatggcggcagtcaccacaggcttatactgctcaaactgctcccgaagggtaggctttggcgtttcttcctccacctccacctccggctgctgggcttggatggcatcttcttctgccagttccttttcagcttggattttgtcatactgcgcctgtttctgttcggtaagatagcggcctttctgaacaagagaggtaatgcgcttggcaaccttttcccagttcaagtgaacatccgggcagtcctgctttttatagtgcagtcctttcccatcgtgatcttcaccgctgtgtgttgcgccggacagggcatgagagtgtccgccaatgccatactcgtctttaaggaatctcactttttccttatccgtatgattttccatgaagaacgcataaatacggccttttcctccggcaaaactgctgccgccggtcatggcggcgtcgatctcatcctcggtaatgaaatgctggacggttggcacttgggaaaggtccgaagaaaaagtcctgcggggcaggtcaaggtctttcaggttctcccagatttcccttagcctatggtagtgaaagcgcagcagatcacggtcctgctgataggcagtccagaaggtggcgtattcttccttgagtgtctggcggaaagccgggtcattcagctgctccgtcaggcggcgggtctcctccgggaacccattgcctctgatctctgacaggcaggacaaatatccggcttttctggcgtcctcactgagatcgtgatacagatgccagagcttttccgagaggagggagcgttcatagcctgccgcttctgcaagctccacattggaggcaaactgaccactttccaaaagctccccgatacgctctgcggcgctctcccaggaaatgacctgggcagacctgtcataacggacagacttcccatgggaaagatggataccatcctcggcataccatgcgctcacactgccaaggccattgccgccgtggtacagcgttttcagtatctcggaaatctcagcggtggttttctgcttttcaaaggctgcaaccacacgctccctttgacggtctgtattgccgcccaaacgcagcacatggtcgatgtcattttgggcaaaagaaaaagcagaggatgtatgcgctacattctctgcttcatctatgaattggatctgttccgcttcggagaggaacaggtttagagtcagctgttgataagctccgccatcaggatttcctcggcctgagctttgcaggtgttcatcagccccacccacttcatgggatcgctggctttcagttcctcggtggctcccgcttccttcgccagctggggcatcatctgctccagtctgctctgggcggtctcgtcgatctccagaaggtgcgggtacaacttctcgctcagcaacatctggttgtagaggatgggacgatgttccttcaggtaggttttcctcatcctgccgtacttgcccaggggtttctccggctgctggctcaacttcaggtcgggaatcagatagtctccgttctggatataggtcatgggattgttcatcttgtttgctcctttcttggttggcttcgcgctctgcatttcggacggtaacgccgatctgccgcagcacctgctggttgatctggctgaccgctgttcccagcgccccgatggtggacggggtattgaaatcaaagattgccatgaaatcttcgtggtcgaagtagcgttccggctccagtccacagcgggacatcaaagcgtaagtgatgctgacggtggcggctgccttgaactgcactccgatgttatactcatcatattcctccaaaaaggaaccgtcaacgatatagaagaagtcctgctgatgctccgtccagtattcctcggccagttttccggctacctccgtgagctgtccggcaagatcatcaccggaaacatcataggtgcgctccagcatggcctgcacggaatccagatggcgctcctccaactgccacagccagggagtgcgggaatgttcacgggttccggtgtcggaaatatcaaaaacatagcgcaggcggggcctgtccccggaatcgtccaccagagcgattcccttggagccgcgccttacataccggcccatcttttcattccacaaatcgtactccgcacaggcggtagcgtccggacgctgggcgtaaatcatcagctgctcatggaacgggtacttgtaaaggcgggaagcagtggtgagaaaccctgcccattcctgccagctccccgtgagctgcgttgccaccttctccgccatctgtgcatatagttcagctttggttggcatagtgttctgtcctcctttcagttttggagtaaagaggtggggtggcatattgccaccccatccctgcgattatggtgtttactggtcaaaatccggatacaactccagctcggcaaactcggcatcactcatggcctggagcttgcccagtgcgctgtctgtcaactcccgcagctcggtttcctccggggccagctcgccgcgcatctcacgcaggctgtcgatcagtccggtgcggctgccggtattgtaaatgcacatcaggttcatttcctcaaaggtaaagtttcccatatcaaatctccctttccgcactctttttgggtgctgtctttttgtgttctgtcttgggctggcctttcagctgctccatgactgactttttcttttcccgttccttccgatgaacggcatcagccaagtccatcagggaaatgggctgaccgcttcgggcctgctgttccagctctgccacggtcggctcttttgggccattgttgatgataccgtcgatcatgccgtaatcgtcctccagcatcatttccgcatttttcatcgggttttctggcaggaatccgaggatctgggtaaaaccaacactgtcacagtaatgacaggataccttaccgtcctgtctgatcgcaacgatgtcgctgacgctcatggagggactgtgaaagtccacgggcttttccagattgaattgctgatagagtttttccagctgctccggcacagtgccagactccctcagaggagctgtgtaaatgaggtcataattgctgcggtctatggaaatgtcatgggactttaaccaatccagattcataaagcgcacattctgcggatcgtcacgacttacctgatagatggcaaagcaatctctgttctgagagagaaatgcctgttcgcgttcctgctgatgttcctgacgctccatgaccttttcgtggaactgagggcttttctcccattcctcatggtccacaccgaaaagaccgccatgatccatgatttcctgcggatcaaacaccatgctctccgtattgtcctcatgcagcacatagacggtcaaaccggcggcatccagttccagcgcccgttctctggtaacagggagcatcccatcataggagtagccatattcctgcatatccggtgtggatacctgctcatccggcatggggtattcatccagtgcctgctcctgcgcttccggcagctgggaagaagcagtcatctgactggtctctgccagcatttgctgataggccgcttcctgcaagttctcaatcatggacataggagcgtgtctgagcgaagtgctgtccagattgttgtcatcacaaatctggagaactgcatttttgcgggaaagctccggcatatccagctgaccgccatccagctctttcatggacgcggcatcataaagtgtatagtcccatccgctgtcacatgactggatatgaagataggtggcatcgtcgatcagaaacaaagcctcctgctggttggcgtccacccccagcacttccatttccggcatggccgcagccagttcctttaccgctttctgtaccagcggattatcacggtaatagtcgattgcctgaatggtgtccaggtcaatggtctgcccggtcaaaatcggaaacggtccttcatagtcgcttccatctttcagctcaaagccaatgcccttgatcccgttcattcgctctgctggaatctcctgataaatgcggattgcttcctccaaagacaggttatcgtggtattctccgaggtttggaaattccatgcactctgctacatagtaggtcagatcgccggtcggcagcctatcagataccttaattgcgtctgctggctgctctatcggggcggtttccggctctacctttgcatgagggtcgattccgcgctctttgcagatttccttatagtggcactcaatgtcggagatcaaagtgccggaggttttgttgatggtctccaaactgactctcagctctttcagctctttgccctggctccagcttgcaatatagccgaagctgttttctccggtctcgatgccaaaatacttgcagaccgcataggagatgctttcagcctccacttcctccgtgtggcggtttttgattgcctgtttttctgcggttggatcttcctcaactgcaagacgccattcaaactgattttcgtccacataacgccaatccatatcagaagcaaactgttcggcttctttttctgtggcaaaatccaacttgaaatcatgtttggttccaccttcactctcctgcacaaccttccatgacggtagcatttcatattttttagggtcatggagcttgctgtgggcaatctcgtgtactgtggctgaaaccgtctgaacctcactcatgccctgacgaatggcaattttctgatgatcagcagaaaaatagccgtccgtatcagcggccattgcttcaaaagtaatcggcaccggtgcgctgcggcgcagggcctccatgaatgcctcataatttggcacattgccggaaagggatgatgcaagctccggcaaaggtttcccgtcggtctggctcacatcaaagaccttgaccggacgaaacatggggatctcgatttctttttcctctgtgacgatctttccgtctttatccaaaatcggagccttggtatccgggtccagcttctgctcctcgattttcttcttatacggtgtcggggcaatgatggtaatgccatgctctcccttttttacatgacgctcaaactggtctttccacttattgtatccggctaccaatgtggcgtccggcttctgcatatagatgagcatggtgttgtttaccgaatagcggtggaagcgggacatgacggacagatagcgcatatacttttcactctcaaacagttctttgatgccctgctcgatgccatctgtgatttcccttagccgttctcggttggtgggtttgttctcagccatgattttcaatctcctttccaagtgtgtgatttctgctgtgtgttccgcaatccatgccttttgttcttcttcactttcataaagaaaaaggtccagcaggtactctacataggctttcttctggattgcttccacaaagcgggggtgcggttcttcctccggtgtcctgggagaacggtcggcttcccattttttcaacagatagtagtaatcggacagtacgcgataacagcgctgtcgatcctcccgaaacttctgtgcctcggttttttgccggacatatctcctgcggggcggggcctggctgtcatagatcaggccaaagtcctgtgccagtttctccgccgcttcttttggggagaggttaaagagctttgcggtaaagtcgatcacatccccatctgcaccgcaaccaaagcagtggaaccgctggtctaccttcatgctggggttcttatcatcgtgaaagggacagcaggccataccatttcgtttgacctcgatcccataaaacgctgccgcttctctggtgctgaccgactgcttgaccgcttcaaatacattctctgccatgtgcctttaactgccggactttttcacagggggctggtatccggcggctttcgcacgctcactggcagctttgcgacgctcggcgctgtatggctcccggactgatacacaccgcttggggacggtaaagttatgggcgtcctttcgggtgatctggtcggggtgcttttttgccagcagttccagcttctccatcagacggggatcgtgggtatagacctcagccattggttctgcctggttatagaggagaatggtttcccgttccactaaagagagcttcatcggctgcctcctttccgctggtcaaattccagcttgaagttggcatactgtccatcgtcctccaaaaccacagtggcatcgtaggtcttgccggttttctccgaatatagccccgtcacacggacacggccatcgttcagcagcgcagacaccacagctttggtcggctgttttttcttggcagcccaccatttgttgttttcccagattgcaaatttacaagaatcattctgacagaagaagcctttttgcaattctgcaacttcaccgccgcagcgagggcatttgcccaccacctcacggggcggagtgaacaggtactcggttcccttgatgacctgataagtccccaccagatctttcagcatggcactgataccgtctaaaaactcctccggggcaagctgcccgcgctcgatctcgcccaggcggtactcccactcggcagtcagaagcggcgattgcagttgttccggcagcactgtgatcagggaaactgcatcgtgggaagggagaagctgcaccgttttcctgctcttttttcgttccagaaaaccggcagataccagcttttccaaaataccggcacgggtggccggtgtccccagaccttttcgctcggcgtcctccggcatattctcttttccggcagtctccattgcggacaacaaggtatcctccgtaaagtgctgaggtggacttcttttaccttctttgacgattgccgcagaaatcgaaagggtctgtccttcggtcagctccggcagggctttctctgcgccctcttttttcgactctgcatccttcattttggcacggtaagcgtcctccagtgctttccatccgggatgcttcaccgtttttccttttgtggtaaactccccaccggcacacgctgcaatcacaacagtttccgaatagatatggggctgggctacggcgcacatcagacgcagggccaccagctccagcaccgctttttctcccgcaggaagggcagaaaggtctgcatccttgagatttctggtagggattactgcatgatggtcggttactttcttatcgttgatgaccgtatgcggatcacaggtaatggcgatttctttgcaaaacggcatggcgttggcaaccaggttcaccaacaccggcaggctgtctgccatatcgccagtcagatagcggctgtcagtacggggatatgtgcatagcttcttttcatacaggctttgcagatagtccagggtctgctgggctgtaaatccaagcaggcggttggcatctctttgcagagtagtcaggtcatagagggcaggcggcttttcggacttttccttgcactccacctttttgattgtgacatttgcaccctgacaggcttctttcagctgctcagcagcaactttatccgccatgcgctccccggatacggtaagaccgggcagctccagcgccacggtataaaagggaatcggctgaaaggtgtcgatctcagcttctcgctgaacaataagcgccaacgtcggggacatcacgcgcccgatgttgagggttcggtgatacagcacggaaaaaagccttgtcgcattgatccccaccagccagtcggccttggcacggcagagggcagcatcccgaagtccgtcataatccgcaccggggcgcagatttgcaaagccttcccttatggcagagtcctccatcgaagaaatccagagccttttcatcggcttttgacagtctgccagctcatagacgctgcggaagatcagctcaccctcgcgtccggcatcgcaggcatttaccacctccgtcacatccggggcgttcatcagctttttcagaatatcaaactgctttttcttatcctttcccactaccatctgccaatgttccggcaggataggcaggtcatcatatcgccacttggcatacttggggtcatagctgtctgcatctgcaagaccggccagatgacccacgcaccagctgacacgccagccgttaccctccagatacccgtccttacggacggttgcgccgatcaccgccgccaaattctgggcaactgatggtttttcggcaattaccaatttatgttgagccatgatggttcctcctctctttgagccatcgggacatttcccggtgacagatacctacgcagggtcttccataattcccgcaaccatagcaggggtggctgtggggtaaagaaggaggacgggaagtttccttcccgccctccggcctgcgtgtcatcatgcgttcatagggactgtctgtgaaacgggtcatttcacactgtcctcatcatcttcttctgtgctgcccccgtcagcatccggttcttccgactcctcatcctcggtttcccattcctcggaatcttcctcgccataatcataatcgtccagactgtcattgcccttggtcttaggcttgttcttaacgagcttcaagtaggcaaatacgccaccgccaccaagcagagccagcaaaaggactatcgcagccgggttcaatccggcaggcttctccttttccggctccgatgtttctgccggaggttccggtgctttgcccgtacatttactcttatcagttgcgcagaccgggcaggccgtattgactgcccctgcttcacattttgttgaacagctacacacagcagccggctcctctttgacattttcatcttccatcagtgccatcaaatccgcttcatccacctggttcagaaagtgaacagcagtctttttatcctcattagccctgtcgatcaaaatgtaaaaatagttgccagccttggtggtaacggtaatgagctgcttattgccaccaaaatcatccaccagagcggcattgccatctggtgtaagtgccggtgccggttctgtttcttccacaatcacattgctgtcattggtagaatcctctgccggtgccgccggagcctgttctgacccctgtgcgaaagcagggatcgtaaagccaaatgccacaaccattgtcaggcaaagggcggaaagtgttttgcaaattcttttattcttcataagcggtagcctcctgattatttgattccgacagtgctgtatctctgccgtggttcattccaccggaaagcatagcgttcagctgtgctggagtcatgcgtagcgcacgaaccatctgaacgatttccagattctctgcctccgttttctgtgcttccagggtcttgagcttttcctgatattccgcaatcttctcacgggttttctcaatttcctggtcgatacgttcaattttgttttttgccataaccgttcactcctttccacaaagtctgttaccagttcatcagaccatagcctttaatgctttgataattcaggtcataacttttgatcttgcaggcatcgccggaatttccctccacggtataaacgcggctgccatccgtaccgatcacgatacccacatggtctgctgtcccatccaaatcccaatcaaagaaaattgcatctccgggagccagattgttatagcctcttgcaccccattgtccatgagactgaaaccacggaacgccctgccactcgcagcctgcaaagcgcggctcactttttccagcctggttataacaccaggatacaaagcaggcgcaccactccacgcggctgtcaaagccataccagctccaataaggatagccgcccacattgccgacctgacgcttggccaactccaccaactgcggatttccgggacgggttccatttacaaactgtacaccggtcaagtcctcggaattgctcatgtcaggggaaccaccgccaaacaacagcggcttattgcccatggtctgccggtaaacctgatacatttccatctgctccggggtcagtaactccgacgccacagcggaaatgggtttgctggtgagtttcacattcaaaatgtaatactcataggggacttcttctgaggtggtctcgccggtctccgggtcggtggaggtctccgtgcggtagcgaatctccacttcctcagtaagcgtcagctgatactgtgctgcaaacacacgcgccagctctgtctgagcgctctgccgggtgtaaccttgcaagacggcagacagaaatgctgccagctcatgagggtcatggccgatcataccaaggtcatagcgatactcgtcataccctgggtggctgttttcaatgttgtcgatttcctcctgcaactggacttctctggctgcataatctgcctccactgccagcatttccgggtcatccgacggataggtggtgccggagagaacggaaccgatgctctgcgccatcatggagcaggaggacatggtattcatcagcatacaggtaatgaggaacaaaacccctgccatcaggaaacccttcttgtggcgcatgacgaatgcccctgcctgctgtaccttttcttttaccgtccttgcggcttttccggttttggatgcagcctgggcggtatttccggcagtctgaccggcgtgtttggcggcggcatactgctttttgatggcctgcttttgctgccagcgggaaagagggttgctggcaaactggggattttcctgcaaagatttctggtacagaacatttacatttgccttttccagttgacgctctgcctgggctgctttgcggtacggcttcagcttgtggctgcgatagccctcccgcaccagataagcgccagtctccaccgcttcctcggacttatgggcgctttccacgcccacgttgtcctgctctgtttcccggatctctttgtggagcttgcccacgaccagatggacgggagcttccctgactccttgagaaactttggaaggtggctttttcttgtcctcaaaggtcagcttcgaggtcttttttccggtatccgggtcaatgaccgtctgcctgacctttttctttgggatattggcctgcgccttatctgctctggccgcagctttctccgctttacggattggcttttccagtgcagggtcagaccgttcctcatcagtaaagcgcaggcgcggctccttattcaaaccattctcccagcatgagggaggacatcatgtagtgcagctctgcataaatggccattcccacaggatcgttgaacatacagccggacaggtaggcataaaactgtgccaccacatcggacaggatcttcgcttcggttccttccagaaccagacctcccataccttccttggcacggatggtgctccagacctctgccagacggagcagccccacctgaccggtctcattcagttcggctgcttggtctgccgccgtgcggcactcgctgaccgcatcggccataaccgtaagcagctggctgcgctgggcatttaccgccctgtcaaaaaacatcaacgggttttgattcaaaatgctggggttcatcatcattcatcctccttctttttcagttcctggggtttggtggtcataatgcggtacagctcggtattcttcgggaagtggtccacgaaaggcagaattgtggagccatagaacagcaggccctcgccctcaccggagtgagtcacatagctaagctggtgtgtggaaatgcccagctgcttggcaagtatctgacggtctccgcctgcctggttgagcatatacacgaagtcggagttttcaaagatgttctctacctcgcggctgctcaaaaggtctttgacattctgggtaatacctgtcggaataccgccccatttacggaatcgcttccagatttccaccgtataggcggcggtctgctcctccttcaaaagcaggtgcatctcgtcgatgtagtaacgggtggacttgtgggcggcacggttaatggtaacgcggttccacacctgatcctgtaccaccagcataccgattttcttgagctgcttacccagttccttgatgtcatagcagacaatgcggttgttgatgtccacattgctctggtgattgaacacattgagggagccggttacatagatttcaagggccgtagcgatatactgggcttccttttcctcctgttcccgaagcaggttatataggtcctccaaaaccggcatattctccgggcgcgggtcattgaggtaagtctgatagaccaggcgcacacagcggtcaataatggttttctgcaccggctgcaagccctccttaccgcccacgatcagctcacacaagctgaggataaagtcagacttgagggacagcgggctttcatcatccgagtagtccaggttcaggtccatcggattgatgtagttggcagaggtaggcgagatcttgatgacctgcccatgcagacgctcaacaagaggtgcgtactccgcttccgggtcacagataatgacatcatcactggtaagcaaaaagcagttggcgatttctcgttttgcgctgaaggacttaccggaacccggcgtacccaaaatcaagccgttggggtttttcaacagctttcgatccaccatgatgaggttgttggatagagcattgatgccgtagtacagagcttctttgccgttctggaataattcctgtgtggtgaacggtacaaagatagccgtagaactggtggtcagtcctcgctggatctcgatctgattgagtcccaggggcagacaactcatcagcccttcttcctgctggaagtccagcctggtcagctgacagttatacttctgggcaatggagcctgcctggaaaatgttgttgccaagctgacggggattgtccgctgtgttcagcaccagaaaggtcaaaaggaacattctctcgttgcggctctgcaaatcctgcaagagttttttcgcttcactgccgtaggtagcaaggtcggatggaatgatgtccatgtcgtatccggcacgaactgcttttttctgttcctcgatcttactgcggtccaggtcggtaatcttgcgctttaccgtcttaatggctttcacctgatccaccgactgaatgtgcatactcacaatgagcgagctttccatatccaaaaaatcagccagcagacggtcattcagctccggtgcgagaatctgcaaaaaagaaacagccccgtatttcttgcccatacggaactgcttgccggtgcggaactcaaaggaacttggtgcaataaaatcctttgtggacagaccggaaggggccagccagtcccattcaaactgaaacgggagctgttcatccatgtggaataccgcatgaagctgagaaagcctttccttaccgtccagcgttctggcagctacaccaagacgcttgaagttattaagtatatcggtctcaatacgctccagacggggcttggcagctttgatgctgtctgcgtcgataccaaaagtcaggtatttggtcttgatgagaccgttgttacctctggccagctgattttgcagcattgtggtgtattcctcgcggatactgtcaaaggcatccctctggggcgggatggaaatggagttagcaaaggtctcctccgatgccgcaaggttcaaaaaagacagctggaaatgaatcgagctgtcaaaataattgaggaaatcacaccaaccctcaaagattgccgtcttatcttcgttttgggagagctgatagttgatgtcctgaaactggatggtctttgtgtagtggctgtccaatatgcggcagattccgtccggccacatccgttcataagggatactgtcctgcgcagattttccttttttgtccgtgcggttggcacgggcaatggccgcttcgatctgcttcttatcggcgcgggacagctttttctttgtctttaccagctgcaccgttttttcctcggtttttccgaacatccgatgcagccatttttttattgcggtgaacaatgtcatacacctccttatcgagcatttcctgccgctttaatacggcataaaagttattggtctggtagggacgctgcttgggacggatcacagctactttgagaatgttgcccacgatcttttccaggggctgtccatgcttttcgtacatagccagcataaagaagggcagcataaccagcatcatacacatagccgctacactgtttccggtaggttttctgagcaaaaagaaaagcggtacgccaataagcgctccgcccgtaaaacagataagctgccgcttggtcagattgaacatgacctttgttttgacttttgttaagtccttgggtacgggtacataagccaatgtggaaacctccttccgttttaatgcgcctgaaagactgatttggcgagactgccggttttgaacagcgtaaaacatagcagtacggtgtagcccacgcagctccagattgccatgatgatgtcatcttccagagcgatgttctgcaccagcacagcataaattgccacgcagacgataatgagaaacgcctgaaagcccagcgccagcagggatcggaggtaattctgtcccataccgccccattctttacccatcatcgcagccattggaacgggagccaccgaagtcacaaggtagatctcgatcatacggccataaataacgataaagatacagatatacaacgcccacatggtaatgccaataaagagggattggaaccacagtccgaacagcggtcccaaatccatttccatcagcctcggttccaggtcggtcataactgaggaaatgtcaatggacgcatccgaattgataatccctgccgcctgcgccaccacgctctgcgccatatcaaagacgcccatcacgatattccatgtgtttgtgacaatgaggatggcggcagctgatttgaacacccacttgaaaatcatccaggtatccacatcatgcaggttgttcttgtctgcaatcatctggatcaggtctacggtcatcacgatagccaggatcacgcctgcaatcggcaccatgatggagttggacagattctcaatcatattgaaaatactgccattccatccctgtggggtctgtcctacctgtacggatatatccgcgacctgttggtttacgctgtcaaacatccccgaaaggttgctcataataccgcccaccagcatttctttcagccaatttgtcagggcttcaagtaagaaatccatacggtgtcaacctcctttccgccgcccccgcaaagctgcgggagcggcaaggatttcatacggagacgcttagacagagaaaagcccggagagcagaggtacaaggaccatgcctaccacggctacaccagcaccggccatgagctgcttcatgccctgagattttactgatgtgtgataaagaagtaatagaagtgtaaaaaattttgccgttcctatccggcacatgaggtatgtcggataggtcgggcggttattcgggcaagtccaccttgccaacaaaagaataataaatctcaatgtcctgcctacgggtcttgttctcgtcatagctgcactcatgcacaacgattttctctacaaactcccgcaacagagtaggggtaagttcttcaaagctggtatgccgccggacaacattcataaacttttctgcgttcacggtggcttcctgtgctttggaaagctccgcttggatagcagcggctctttctttcagctcccgttgttctgcttcatagtctgccgacagctctgtgaaacgctcgtctgatatgcgcccggtcacgctgtcctcatacagccgcttgaagatagcggataactcggctatgcgtttctcggcggcttccagttcatttttcttagcggcgttcctgcgcttgcccccgtcctcgttctgctcaatcaagagcttcataaaccgagcttcatgctttgccgcatagcttgtcactttccgcagattggagagtacgccagcggtcaagaggtcggtgcggataaagtgcgccgtacagtcatgggtgcgtttcttgtagttgccgcagatataacagtcctgcttgcgcttgtccgtctggtatcgctgctgatacatgacactgccgcagtccgcacagaacagtatgccggagaacaagcccacttcatcatagcggttcggacgcttgcgctgtttgcgtaattcctgcacacgctcccatgtctgggtgtcaatgataggctcatggtggttctcgaaaattgcctgtttctcaatgggattttctacgctgtgtttggtcttgtaggacggtttctccgtcttgaagttcaccagacagcccatgtactcccgattttcaaggatatgcaccacagtatttgtcgcccatttgcattcatagccggggtgatagcggcgtgtgctgcccgtcctgcggtattccagcgtccccggcgtggggatttgctgctctgtgagcatacgggctatcttggtcggaccattcccggcaaggcagaggttgtatatctgcttgactacgggtgcggcttcctcgtcaataatgaaattttcgtcctcgtccatgaggtagccatacacaggcttgcttgtgatgggcttgccactcatgccttttgagcgttttactgctttgattttcttgctcgtatctctcaccagccattcgttaaagatattccgcagcggggcaaagtcattgtcgccctgtgcgctgtccactccgtcattgatagcgatgaagcggacacctttctgtgggaaaatcatttccgtgtacattcccacttgcaggtagtttcgccctaacctcgacatatcctttacgataacggtagccactttcccggcttcaatgtccgcaagcatggattgaaaacccggtctttggaagttcgcaccagaatagccatcgtccgtgtaccagcgcagattggaaaaaccgttctgctttgcgtaggtttcaagaatacgcttctggttggaaatggaattgctttcgccttgcagctcgtcctcatgggatagtcttggataaagggcagtgattttctgggtggtctgtcttaacataaaatcctccgtttccgacagccagccccactattccgtaccttgattgtaccacatggggcggctgtctgtatagcggcaaaagcgtcaaatctgcttctttatggtcggtcaaatcgctgttttttgtgtagcagcttccgcttccagcactttcatcatcttgtcggctgcggtatcggttgcgccctgcttgaagaagccggaaacggtaaggacggagttgcccatgcggatttccgttacacagtccggacggcggtctgttttggtggtgcttgtctgtttcgtttctgtcataggctctcctttcgctgcttcatcagttgctttaatcgttccagcttttcctgtgcggtttcctttcggaaattgctgcccgtgaagcggacgggggcgcacatagaaagcagcctgtcatagatacgggcgtggggcgtgtcctgcgggtgctgcaattcctccagcgtgaggttggtcgtggcgatcagcggcttgccacttcggtaacggctgtcaatcacgctgtaaacctgttccagcccgtattccgtccctcgctccataccaaaatcatcaagtatcagcagggggtagctgcaaaggtgggaaatatactcattcctgccctcaaagctggcggcaaggtcattcagtatcgttgcaaagtttgtcatgcacaccgggacttcctgctccataagggcgttggcgatacaggcggcaaggtagctttttcctgtccccacgcctccccaaaacaggtagccgatattttcagcctgcatggtttcccagctctccacataaaagcgggcggtttcggtctgtgggtttctgccgttgtcatgctcaaatgtccagttccgcatagcggggtcggcaaagccccggcgtttcaagtcctccactgtttcaaggtgcttctgtcggctttcggcggcttgctgcttttcacgggctgcccgctggcagtcgcagtctgttgggtgtcggtcatgccctaaccattgggcggtttcttttgaaaagtaggcttctttgggcgtatggcacttgccgcagtataaaagcccgtcctcgcctgtgtagtcctccgcttcggcggtagtggttgtaatatccgtaatcatagcttcaatctcgtttttcataagctctcgccctccttacatgaataatcgggtatgccctgtttcggggcagccttgcctttggcagcgtcctcctgcgcccacttgtaaatggtggctgcatggctgtggtactgcttcccggtggaagcgatatggcaggaaagccggtcaatataatactcccacttgtcgggcagctctgttttcagcccggaaagctctgtatcggtcagtatcacattgttgtatctgccataagcggcgggggcggggtgtcccgtttctccctctctctctttttctatctctttctctaactctatctctatctctggtggacgaatgtcggacaaatgtccgccttttgtccggggcggtaaaagtgccttgttttccagccttgcagcccgttttctctcggcttcggtagaggactgtcctatcatcagctcaatatcggtcatataaaaagccccgctgtcaagctgctccacaagccccaactgccggaaaatctctaaagccctttcaaccgtccctatctggtggcgggtcagtgtcgctatcatctgcgctgtgtaggggatatgctcgtcaagctgcaacttcccgccgtttttcagagattttaagtacagcttcaagaggatattggaatataaaatcccgtctttcatatcttccagcagcacaatggagtcgctgtcaaaaaaattctctttcagcttgaggtagtaatacttgcggttatctgccattgtccctgtcctcctttttccggcgtttggagtagtagcgggggcaaagtatgataaccgcccggaagctctgcttacagctatgggtacagccccggcagaggtcgttgtatgtgatacggtcgcaggtggtattcccgacttttacttgccgcaggaaaaaagaccattccagccgccgtttcttgctcattcttggcatgggtgcgctcctttctgccgtttccgctggtgtggcggtatcgacggtaattctgtatcatctcggtatcattttcggggtttttctgccctgtaagcccgttaaaaaatcctttggtattgcgggtagagtacggggcagcccccttgttctgtatgggttcgggtacattttggggtggtttttatcgttcctgttcctgccttttcacaggcttgcgctcccggcgtaaaatctggtcgatattgcccttgacagtctgtaagcggcggtattcctcccgttttgcccggtaatcgttgtagccgctgtttttctctttgataaggctttcaatctctgcttgcaaggctttatagcccggcagcttggaaatgccgttctccctgaaataacgggcggctgcgtctgctatgataaagtcgctttcgtgcttctgtcggtaggctgcttttgctttggcgtttttctgctgtttcagcccgtcccggacagggcgggtcttggaataggcaagtacctgccgttgcagctcctttttcctgttcagcgtcttttccacctgcttcagctctgtaaggctttcctgcatggcggcataggcggcagaacaggcttcgtccagttcctccggggaggaaaagccgtactgctggtaggcggtaacggtagccgccatctgctttaggttgtgctttgccgcccagcggtcatagcccacgcccttgccctcggctcgcttggcttcccggtcaaccatgcgctgcaaggtgttgtctgccggggcggtttttgcggttttttcctcctgcaagcgtcccttttgggtatgtgggtattccggtatggctttaggcttttcggcggctctgtgggcgttctgcgtgagcagggcaaggacagcagccttgtcaaaatcgtcccccagcttccgggctgtgataggctttgttctgtccggcgtgaggtaggaaagccgcccccggctctccttgacggtcacgccctcccgcagcaaaagggaagaaaactcgtcaaagctggtagcttgggaaagtgcctgccgtatcgtccggcgcagcttcgccttgtccgtttcaaacttggtgggcttggtcggttgtccggcggcttctctggcggcgttctctttatcaagggcaagctgccctttctttgccgcccagtattcccgttctgttatccgttccttgctgccgttcaagaggtcgatttggtaaagcccctcccggtggcacatctccataacttcactcttgaaatattccatagcggcgttggtacagcggtgcttgcagccctcccgtgtgtcggctggtctgtccatgtagggcagaagcgggacttcataaatccgcagggagttgaggacgatatgcacatggatattcccgctgtggttatgcccgtccgggtgggtgcatacaagggcttggtgtccggggaaatgctctttacagaactgctcgcccagctcctgcgcccggtctacggtcaagccgttgtctgtcccgtcccgtgggtcaaagctgatgatatagtggtggcttttcacatcttcccgtttttggtttttctcatagcggagattggctcgcatacaggcaacggcgaaatcctcgcccccgcagttaagggaagaaatgcggtagtcctccctcggtatcagccgcccgttttcatcaagggtgggcttcatggtaaactcgtcatgctcaaatgtgaggtaggcttccgctgcgccatagtcggcatttttagagctgatatgtttgaatgttgccaacagcatcacccactttctgcaagacttcaaactttagggcagcaaggtcggaaaccgccgcccgtacttccccggcaagctgcgggtagggactgtgccactcgttcagcgtccgggctatctggtttaagttgccgccgatcctgccgtattcggcggtcagcttcccgacagcggcaagcagctcgtcattgacgggggaaacggttatgatggggcgtatggctgccccggttatggcttgccggataaactcggcttggctcatgttgcaggcagaaagcctttccgcaaactcggcgtattcttcctcggtcatgcgtgtcttgactacccggctgcggtgcggcgtgttgtatcgttttcgcatggtaaaaacctcctttcggctgccgcatggctgcggcgggataagcggcgtaagccgcataagcagggtttggggaaggcactccccaacaagattcccgcaggggcaaaatgagcgaaaagcgaattttggtactgcggtagaatcttgctctaagaaaacggcgaaactccccctttactccttactacgcagagaaatgcaaatatggcaaagttttgaaaaactttttgataaaacttttcgacaaagctggaaaatcagcgcggtttttggcgcaaaaaaacaggaaaccttttctgatttcctgtcatggtatgccgctgtaacgggcggcggttattctgttgtcattccccggaagcaaacttgtagcccatacctaaaacggtttttatgtaaatgggcttgcggctgtccggctctatttttttccgcaggttgtaaatcacatttgcaacgcttgactggcagctttcactttccatgttccaaacggcttcaaatatttgtgtccgtgtgaggacaatgccggggttggaagcaagatatacaagggtactgtattcaaggcgggtaaggcttacttcctccccgtcttgaaatacccggcgttggttctgctttatttccagtcccggaaaagataacacggaagcggttgtgatctgcatgggttcaatctgtatataatcagatattgccgatatgattttgtcaatcgctgtttcctcttgttcgttaagtgtcagcagtagtaatttccccatgttcattacctcttttatccgttgaatttaaactatatttttctgtcgtgtttttgacagtaagcaacaaatatatatgatagagagcgtaatgtcaatttaatgccattaaaagagaaagatggtctgtctaattattatcattttgttcatatgcacttacgctgcgtttggcatttaggcaattcaatatattgtaaatttatctatatcagcgggctaacctcattttcacaaaataagctaagtttgtgaagcgctcttgtgcaggcaacatataagaggtttttatcatcttcatcatggtagttttggctatctgcatcacaaattaagacagtatcaaattctaatccctttgacatatatactggtaagataaacacgccttgtaaatctgatacgctcccatttttaattaattgaatatcaagtttgtgtttaattttattaaatagataggttgaatttttttcggttttacaaattaagcatatcgactgaaaccctttctcttggcataattttatttccttaacaatttcatcaatgaagatttcggaattatcagcaatatatacttttgggctatcgccattccgattaaaactttttatctgtgaactttgttcaatgaactttaaactaaaatttaaaatttcattcgtacaacggaaacttttatccaacataataagagaagattttttcttgttcaatattttttgaatttgttcgtagaaagaaatatcttcttttttggcaagagtctgtttcatatctcctaaaatagtaaatttggcattagaaaaaagcaaattaaatatttcatattggagagggtagtagtcctgtgcttcatcaatgactacctgcttaatatttttatatttatttgttccgtatatttttaaatacaaataagcgattgctattgcgtcatcataatacaagctgtctgcttccaaattttccttagtatatttccaaatattttttatgttttgtgacggattgctattttgcagcaggctataaaaataggcttcattgctaaataatattttatataattcaacaatgtcaatttttataaatttctgtatttcctgcttgattagatttttttcttctttatgcccccgcccttttcctgttccaaatatttgttctaaaatataatcttctaattgttctaattttatgcctaatggtgtttctggtcttcctaatatcttgtcttttagaatttgcccgcttacaacgcattttccctcataataaacatcttcaaattctatccactggcggggtatatcaatgagaaattggtctaaaatttccctaaaaaaacttgacgttttaaattctatactatttcttgaaatttccttgtattttgaattgacaatcaagttttctaaaaaatcatttcttgactgaattttcctgccatttaataactcactaagtatatcttcaaacacggaagaaataacattatcttctcccaattcgggcaatacatttgaaatatattgctcaaatatagaatttggggaaataatcataatgttatttgcggacagctttgtttgtaaaccttgatacataagataagcagcccggtggagagcaatagaggtttttccacttcccgctacaccctgtaccattagcaggtcattttccatatctctaataaccacgtcctgttcatgctgaattgtttcaacaatagctttcattttagcagtagtgttttgtgacagtaattgccttaaaaattcatcaacaatctgaacatctgaatcaaaaaaatattccagtattccgttttttatttcatattggcgtttcaaattgagttcacctgttactcgtccacatggagcgtcataaaacgcttcgcctgtcataaaacgatagaaaacactggcaatcggcgatctccaatcataaacatacatctcttgatagctgttttttcgtagagaagaacgtccaatgtatattttttcgaattcgtcctcatcatcaaatttaaaatcaattcgggcaaaatagggcgattttatcatcttttctaacagaagtattttatgttcttcttcttcataatctataattttgtctgtaacaggattgatatattggcttaattcaacaagtgcctcgaaaccgtctgatgtgtacagtgatgtaatgccgtgttctgtattttcacgcacatcttttttggcttcgataatttctgatttctttttgtctgccgcttcttttgcctgctttaattgttcctcggctaaagagattgtttgtgctaatcttttttcttcaaacgctttttctgtctgattattccccataatgattatgacctccttgaaaaatgaaagaaagttttactgaaacattgctaggctagtttagcatgtgtcagcttatataaacagtcttgtatttataaaatttgtatggtattattatagtgggaagaagtatgttagatatttgatttctgcaagcatatcaattctaatacggacgtgtaatttaagcaataaacaaattgggacaaagcagttataccgctatgtcccaatttgctattactccatatcttcagcagacagaaacacaagcccgacaaattcttcctcaatcagtttcttcaacttttccactgtgctctatgcaggctcccgtatctccattccaacctataatctctttctgtaaaagcaaatcttgttctgtgaaaaaatgagttggattccgtagtagtcggcattgtgcgtaatgtgtataactgactgtatcatggaattgtgggtaactctgtttgcaggacgtgggaaagctgcactttagcttttccatgtgctgtgaatagagttatccatgattccatagcctgttatgcacatttccacaatgtttgtcttttggtcgttggttcggaaaagaaaagccctgtatgttattatatacagagccattctaatctttttttatccactacatagagcgtttcctttctgcaaaattcattttacagagtgatacccgccttttttgcaaagtagtcttttctcccggtaagctctgactgtttttcctttggaagattgttgaataaatcatcataaagaacatcagctaactgcatttctctcgcaagcaaaaatacatttagactaagccattcctcccaaagcccctcaaataagctgttactgtctgtataggtgtcaagctcctcaaagccatgtgacgctgtatagcattgcagtttaacaaagccatacctaccaacatcaaccaacaaaatatcttcgtcctctatttcgtacagttcctcaaacacatcaatcactttgcgacacttttcccgttcttcctctgtgatatatactgttttttccatgctcaattacctctatcctttcaaattgtggaatactgttttcagttttcttctacttctgaaccacatatttgaaatgccatatatgccattttatacggaatagaggttggctgtctgcatttatcagtgtgttactttatggcacatgagcattggcgccggggttgtcgttgccgtaaccttccagcaggttgatgacgccccagataccaagaccggcaccgagcgcgataacgagggtctgaagaacggtgattgcctgttcaaaaaatgccatatagtttgttagccggaatctgattaaaaaataggtttgtcatgtttcataggcatacaaaagccggaacaatctgccacccggtttccgggggcatgattccggctgtcctcctttttcattattttttcttgcgattgtccgctttgtacgccaatggcccatagagggcaggtgcggcgaatagataagatcactcccttctaaagcggaacgaaattaagcgccctttgtgtctacttcatatacatcgcagacctcattgggcttgagtttcagccttgcagacaagaatgcttcaatatcaaaagcgttcttgtcatccgcgtcggcagtgtacttgaaattggggtgcttggtgatgtcgtacttatccgaaaggaaaggacgcacaccgcgcagctggaggatacacttgccgccatccataacagcaagctcatcctggctcatcagctcttttcccaatttttgatagttgagagagtgggaagtttcccggccacggctctctccggtgttgtaggtgtcgatggtttccttgcccagcacggcagccagctctttgagggtagtcggctctttaccacccaggaagatggaagtatccatgtttccgataatggtatctgcgttatccttatagatcgccttgagctgactctgcgcctgcaacaccagacaggctgagatctcacggcttcggatcgtggccaccaacttttccagcttcggaatctgcccgatgttggcgcactcgtcaatgagacagcgcacatggactgggagcctgccgccatacacatcgtcggctttttcgcagagcagattaaacagctgggtataacacatggagatcaggaagttaaagctatcatctgtatcactcataatgaggaacagagcagttttccggtctcccagagtatccagttccagctcgtcataagctgtgacctcgcgcaactctgcaatatcaaatacggcaaggcgcgcaccgcaggaaatcaaaatcgacttagcggtcttgccggcggccagcttatatttcttatactggcgcaccgcaaagtgatttggcttctcggcttccagtgcatcaaacatcaggtctacggggtttttgaactcctcgtcatcctccctgacttccatcgcattgatgaactcaatgagggtggagaagttctgctcctccaccggagcctcatagtggatatagccaatgagcgcgcagtacaacagcgtctccgcttatagtgataggtaatcctttgaagttatcgccggattttcccccactccacaccggacgtgcgactttcaccgcatccggcgttccatcggttgttttcacaagcatttaatcaatcaccaaatgaaatgttagttttctattgcggacaaaccagcctgctggcgcagactgttcacttttaacatcagttcctttgttgccttgagcgtgtcggctatctcttttagctcattcttaggacactcttgcaggagtggaagaaatctattatggaacaaaatcatatttcgatagcgttccttgccgcccaattctgccggtgttttcagccagcatactatgtcagccgcattttcaaagagttccccacttagcgcacattttccacgttgagccgagaatagtgaaatcctgctgtcagtaagttctgtgcttcgccccatagacggttgattcctcaaacctgatagaacagatgagttcatacttaggttcgtgtgtatcaatgcccgtccctctaccgtgtaactgcaaaccgccgctttctttgccatcggtatcttgttcttgatgtatgcgatagggtagataggttggtcgattccagatacataccgtatcattgccgactttccaaaccgttctttttcgctctcggtcattgcgccgccctctcgaacaagtctgcacccggtttctgtattgagccgatttgttaaaactgtcatgacctgtctgtggattttcctgcaatcaatgctgatgcaggtggcaagttgaaaataattctgtattcccagaaccattgaattgtacagccgtatttcgtccaaaggtctttttccctctgaaggtcgggcaattcgtttcgcctgttccaccagtttttgcctttccagttccaactttttgtcacagatatgagattgcacgatgtacttcctgtttttcggtctgactcgtatcttaaacccaagaaactctgaatagcgttttctaacattgactatccttgttttctctggcgatacctccaacctcagcctctcggttatccatgccgttacagcctctttcgttctcaaagcgtcctctttattccggcagaaaattctgaaatcatctgcatatctcacgatatacatttctttcaaccctgttttcctcattttgaggaatgccttgctccggtcaaaagtaatcgagtttctgattttcctctcatacccgtattcctttacaagagggtggttctgccattggctctcaacccatttgtccagttcattcagcacgatattggcaagcaacggtgaaatgataccgccttgcggagtgcctttgtctggaatgagtgtagtgccgtctggcattctaatcggtgctttcagaatccgcttgataataaaaatcaactgcttgtcgtgtattcccattgcccatatttgccgcattagcttgctgtgatttacgttgtcgaaaaatccttttatatcaaactcaatcacataatgcaggttcatgcgttgaagcatggtgtaagttttctgcacggcgtgttccacggaacggttcgggcgaaagccgtaactgttgtcgctgaatttcgcttcgcagattggctctatgacctgtttgatacattgctgtaccagcctgtcccagatacagggaatacctaacggtctggtttttccgtttggtttcggaatgtctttgcgtcttaccggctttgggcggtatccgtgctgacttcctgtgacaataaacctcactttctctgcaactgtttcgggcggtaaacacccgatgtcactgatgtttttgttgtctgttcctgctgtgtagcttcctccgtttgctttgatgttccgatatgccagaagaatgttgtcccggctcagaattaaatccataaggtcggtaaaattttctccctccaaacttcgatgatagagttcatcaaaaactggctgcataccgtaatactcggcatgacgtaagtcatctacacatagagttttgtttttctttggcataaggcatcacctcctttttgcgaaagtgacccttttggtcttactcgaatccttatgttggattgaataatgcctgcttatctcaatcgacttgtggccattcctccgtagctcacataacgcaagcacatcataggttcgaccactacttttcagcagcagttcgtctgcttattgtttttcgtcagactattccttgcggaatctgctgcctttcctcgttccgatagttctatctgttcatacatacccgtaggttcctgctatagacctgtcggcttgcctgtgcctgtaacacagcatggtcgttcgtaggatcaatttctactaaaccacaccgactgcgcattaacgcacccacacatttctgcgtggtcttcttttagacctgtacattcgcaggttcgtcagtccgcccgccaaagcgaacattctaaccataggtatcttatagactctcggcttataggtaacacagtctgcctccagaccgctttcgaccactttaggcagtggttacggttactctcagcctttgtcatggggcttcgtacaccagccattacagctaatgcacgcccatcaagggtaggcgtttcagggcgttaccccgtcattccacctatcaaactaccagttctccgaacaacggaaaaccgttgctcgtgcgcagactttttaccgtctgcgaacgagtcgcactgacccagaaatcgtcgccagccttgccttcgcctttggtattggcaatcagcgtcgtaaccagcttcaagatgtccttttcgctgtgaatgtacgagaaaggattgtagtgcatactttttttgaagttgatggtattcaacaccttaatccggtatggctcatagattacctttccgtgcttgtccttcatgggctttccgtccttccccagcttgggcgcacccctttggagcatttttccgcactccaccagaattgttcccttcgggtccgtcacaacataggagctgtgcatctgcatcaggttgggtttcagccagaatcgggtcttaccggaaccggagccgccaatcaccagtacatttttgtttctggcagtcttggggtccttggggcggctgttcatggtcaggctctccgtttttgtcagaatcacattgttctgaaatacaggatcaacgtaaggtgcaatatcctcacgggttccccagcgggccgaaccatattccaaaccatgtcgatatttcttggcgttcttgcttttaagatacaccgccagcctcagaccaacaccgcagcacagccctaccaacaagtccaatggatgcaggcttggccagaaactttgcaacgccccaggcagaaccgcaaccagcgaaagaaacttttctgaagcatccgccccttgtgccattcgccatgcctctccaaaattggtagcaaacagccccagcaggatatacggcatattcagcaaaatgagctttttgatgtccaatgtctttttcatcgttccagctcctttcgcttggtgcgatccaccacagcatttttaaccatctctttgaactggttaagttttgccagtacggacgggcgctctgttttcgttgcctttttgacctttttgttggtgtactctgtaaaagctgctgtcagagcatctgcatcacggcctttgaaaaaaatcaggtactttggtggagaactgctgcgatcctttttcaccgcataatccacaccatatttccgggcgattttctcaaactccttgatagaggggtctgtgatctcaatgttggatattccctgattctgcccgacaagctgcttcacagtctgttttccatgcggaacaaccggcgcatcacggcttctctgtttttccagcttcttttccttgcgatgtgccatgtacttgcttatggcagccttaaacattctgccggtaaactttgttccactgacaaccagcgtcaaagttctgttttccacttcttcctgcattttctcgcctcctttccacgaagtttgcagggaatctctttttttgctaaggcggaaccaccagccgccgcagaagataacgcttcataccgccctccttagcgtaactggtcagaacggtcatagtgcagattgccctggcgtacctttgcgtggctcaaaatcttaatctgccccttttcctgactatccagtgctttttcataaccggtatccgacaggaacaggcgtgttcgttcgcctttccagccaacaggggaatcgttcgtcagcacatcaaaaataatcatgtgccgggtgtcctccgcaaaacgctggaggtccatatatccatgaccgtgataattctgcgctcctgcctttgcccgcatttcttccatcagctgccctatggtctttccctcagacatcatgcttactcctttctcccggcacttccgggcaataaaaatagcgaccatttaccagccgccatacagatcgtgatttacttgtgaggtgtaatgattgcttatcgtggtcggtgcattgaacagaacggtcagaagatactgcttcatgttacgaatttccgtggtgttcttctgtaaacagtccatgacaaactcaatgtgcgagttatccagcttcaagaatctggaacgaacgatttcatgcggaaaatcacttcctgcaatacgggttgtctttcgctttgcacagaccgtttccacgattagctccacaatctcatccaaatcctcccgataagtttcatactgctgacacaggtattcatacccgatattctcctgaatcaattcccgataactctctatctctgtgagtgacatcgcatcccttcctttccgttccggcagacaatctgccgcgcaatcccggaagggaatggaatcggtacttgatccataaatattttgtttttgagtatttgatttctctatatttaattctgcgggcttttccgtatccggtttatccatatacgggttttccgtatctggtgaatccgtatccggttttctaagctgtggctgctcgtatatgacatactctgtatcgctgatgcgtccctgccggtcacgcagcttgtgccgcacaatgtaaccggcagcctccaattcccgcaacgcagcgcctatggcatccacgccctccttacagatctttgcaagaccacgggtggtgtaattccagtcctctggcaaagacagcatcatggaaagcagccccttggcttttaacgacaggtttgcatttcgtaaatgatgattgctcatcacagtataatcacgggtccgttcaatgcgaaaaacggccatcgacctcactccttccgaattttgggtacaaaaaaaccgcaatcctcattccaaagaattgcggtgttcaacacttttcaaattttcttgcatagaaccaaaacagcggctttcgaggacgcgcctctgtaaatggctcctcctgggcgaaaggaagtgtttgcatcactcggtcaatatccgttgattccatgtcatgctgagatttgcaatcttcccggattgcttcttgaatttcctttaccgtacacatagtcattcctttcctttcgttgtatgggtttatgagcggcggcgttttcccggtttgaaatcgaggatatgtccctcaatcacacgagcgtaacgcttgatcttaatctcccgacgctgctggctttgcagggcagcctgatacccgtcctcggtcaaaaacagccgcatttcctctccggggctgccgtaagctgtgctgggacgcaggacggaaaactcaatcatccagcgggtgttatcccaaaacctctctacggcgagaattttgtgtcctttcagctcacgggctgaaatatccctcataggcggctcctttcatcgttcctggtctctctgacgctttttctgccatgcctccagcagcttgatgatggtttcctgcatccgctggggcgtatagcttttagggaaatacttccgcaaggtatcagaggtaaatgtcactcggtccagatcgcttttcttttcctctcccatgatgacacgcatcatatcgagggtcagatgcccctcctgactgtatttcttgagccgctgggcttgagaaagagaaggggtagcctgttcgctgtccatcgcgtccaacaggtctacctgttcctcctttttgagaaaggacagctcataggcgggatttaaggcaattttcttttcatccaccatgtccagcagttcgggaatcagctcagtcaagcgaataaatctctgaacctgcctttgactttctcctgcttgatttgcaaccagctgaattgatgtctgcgacttctcgccaacttggcgagaagttaaatctgagcgttctccctgatgttttatagcctccaacttcattttataggcaaaggccctctcacttggaagcaggctttctcgttgcaggttgctgtcaaccataataattgtggcagcgtcatcgtccagatcacggacaattaccggcatggtctctttttctgccagttcacttgctctgtgccgtctgtgtccggccaccagttcataaccaccctccgggtcagggcgggcaatcgcaggaaccagcacaccatactgcttgatactgtctgcggtttccagcattgcttcgtcatccttgactttgaatggatgccttttgaacgggtgcagttccgacagcgggatttctactactttttctctctgagcatcggcacggctctcctccgtagaaaacagatcatctaccgatgccagctctacttttttcgcgctgcttttcaagtttcaacacctccttcgtcagatttcgatacccctctgccaccttgccgccagggtcatgggcgaaaatactttttccctctgcgctgatttcctttgcacggacagagtgtggaatctccgttccaaagactttgattttacttccataggtgtcccgcagcaaagcagcaatctcttttgcaaagttggtgcggttatccaccatcgtcagcaggataccgtcaatctggagctttggattgatctgccgtttcaccttactgaccgtagatagaagctgttccagtcctttggcgggcagatactctgcctgcacgggaattatgatcctgttcgcagccgccagcgcattgaccgtaagcatccccaacgagggctgacagtcaatcaggatatgggagtattgccccttcagtgtgtccaggtattgccgtaaaatcgtttcacggctcatggcgtttaccagagaaacctccataccggaaagctgaatatccgcaggcatcaggtcaacgccttctgcatgatgcagaataccttctccggggcgtataggctgatccatcagaattttgcccattgcatccgacagtgtaactggcagcttgtccggttgcggatttcccaagctgattgtcaggcttccttgtgggtccccgtcgatcagaagcactttctttccggcctgtgccaaacctattcccaagttcgcacaggttgttgttttgccaacgccgcctttctggtttgcgatggcgatgatttgtgtgttcatgacttcacctcatttctgattgttgctgttgtttctggaaatagaaaaagccgccacttcaaaatcataaagtgacggccctttctaatgccggaatctctgaaacaaaaaaagcacccagttatttgttactgagtgcctgcattagaatcgtatttaattgttcagatttggtcagattatgccaaaccctccagcgaaaaatccggtgtctgagagtgccaaatcaccctcaaaaatacccccgaaattgctctctggttgtcctattttttaaccactaaggccgttttttgaccccatttttgccggttgtcctatatttaaccactaaaaattgggtgaaaacggctctcgtttggtcaaatcaagtcaaactatatcagcccgtttaggtataagaaaaccccggaaaaccttgattttccggggtttttgaaccattttgatatagtctgagcagtcgattatcgcttgctgaactgcggagcgcgacgagctgctttgagacccggtttctttctttctttcattcttgggtcacgagttaagtaacctgcagattttaatactggtctgtattcagcgtctgcttcaagcagtgctctggagattccgtgacggattgcaccagcctgacctgtgaatccaccgccatgaacgtttactaatacgtcgaatttgtctgctgtttcagtagcaactaacggctggcgaacaacaactttaagtgtttctaatccgaagtattcgtcgatatctcttttattaattgtaattttacctgttcccggtactaagtaaacacgagctacagatgattttcttcttcctgttccatagaattttgtactagccaatgttctttacctcctattaaaatgttaatacttctggtttctgagctgcatggttgtgctctggtccagcgtatacgtgaagttttttaatcatgcttcttcctaaaggtccttttggaagcatacctttaacagcgagttcaagaaccttttccggttttttagccatcatttcttttaatgtggtttctttcattccaccaacatattctgagtgatgatagtaaattttctgatccatttttttaccggttacagctactttatcagcgttaacgatgattacataatcacctgtatctacatgaggagtataaactggtttgttttttcctcttaaaacttttgcaacttcagatgcaagacgacctaatgtctggccttcagcgtccactacataccattttctttcaatcttatccggattagccatataagtgttcatggttttacctccctaattttcaacatatcataatctgattacttcataaataaaatttatatgaaaatactataccggggcttttggctaagtattttcgcactacgtcacattgagatattatattatacttaccctttaatgtcaatctttttttaagaaatattacaacatgaaacgcaaaatctttcttgttcttttttctctcacgattctactccgattttcgggcagatatcatttaagcagcattgttcacaatgcggttttgttctcgccgaacagacttctcttccatgatataccagtctgtgacagaattcactgccttcttccggtggaataattttccaaagtgccatctccactttctttggctctttgattccatctacaagccccatgcggtttgtcaggcggatacaatgcgtatctgtgacaatcgccggctttccaaatacatcccccataatcaagtttgcactttttcttccgactccaggcagttttaataactcattaaaatcatccggaacttttccgttatatttttcttttaacatacgcatgcaggcactgatatctctcgacttgctttttccaagaccacatggtcttacaatttcctcaatctgctctggttctgcttttgcaagtgcatccacatccggatatttttcatataatttttctactacaatattcactcttgcatccgtacactgtgcagcaagacgcacgctgaccagaagtttccaggcttcattgtagtctaaagtacaatcagcatctgggtattcctctttcaatcgttttatgacttccaaagccatttcctgtttttccattgtattttctcccgattatcattataaagcggacattcgcatccccctcacccgccgcttagtgctctgcgcacttgaagcgtgggaatgcttatctgcgttcaactattttatcgcaagccgattaatctgtgttgcaagataacccgcaccatatccgttatcaatattgactgttgcaattccatttgcacaggaattaatcattgtaagaagtgccgataatccatgaaaacttgcgccatatcccacagaagtcggaacagcaatcaccggcacatctacgagaccaccaattacactcgcaagtgctccttccattccggcaaccgcaactacacaattcgcatcctgaatttctttaatattaaaaagcaaacgatggattccactgactcccacatcaaatactcgctctactttcgttccaaagtattctgccgtctgtgctgcttcttctgccactgcaatatctgctgttccggctgtacacactgcaaccagcccttttttttctcttttctttccatctatttttaaaattccggaaagcgggtcatattctgcagccggaaatttttcttttaccagctcatattggtgtacagaagcccttgtcccaaatacttctccgtttttttcatataactttcctacaatatgaagcaggtgttcatccgcttttccactacagaaaatcacttccgaaaagccggaacgaacttctctatgcatatccagtttcgcatatcccatttcttcaaacggctctctcttaaaataactttctgcttcttctattgatatttttcctgattttacctgttctaataattctcttgtttccatttctatttcgattgccctttctgactgtcaaataatttgaaacagctttattataagcatttcactaaaagaaagtcaatcttaatgtagtcgctcaaaaaagaagtacctgctcatttttgcaaatacttcttttttcaaaatttataccttttgatacggcattttctgatacataatttgttcaaattcctcgacaggcattggatgtgcaaaccagaacccctgtgcttcttcacatcctgctgttcttaacacatcaacctgttccagattttccacgccttcacagaccacacgataaccaagccctttcactactgcaacaatctgatgcagaaaatacattccacgttcacttgtcttacagttatccataaaaactttgtcaatttttaccgtattaaccggaatgtcaatcactgtgtttaaaagggaatagcctgagccaaaatcatccaatgcagtctgcatattgactttctgaaatctttcaaacaatcgttttacgttgtcataatacgataccgtcgctgtctctgtcagttcaatttcaagcaaagcagggttaattccataacgatttaaaatctccagataatgctcaacagtatcacaatctcttgcgtggaggattgaagcatttaccgaaatcggaatcaattttctgccctttttcttattttctgcaagaaactttacaacttcttcaaatacaaaaaagtccaaatcaataattcttccatttctttcatataaaggaataaatgcatccggtatcataacagttccatccggtctctgccatcttaccaccgcttccgcaccgataatcgaataatcaaaaagggaaactcttggctgtaaatagattttaaactctctgtttcgcattgcaaggtcgaatccattgataatttcattttccactctttgtttttcttccatctcttttccgtaaaccttcacactgattcctgttacctttgagacttgtttccttgcataatttgccgcatcaattgcaatagacgtatttccatttgcttcttcaataaaataaattcctgtccgaatccgaattctggtatccggaaaaattctttcctgctgttctacaaaggtttgatttaaccgatctactgcctctgcggtatcacttctttttttatacggcataaacaacaaaaactggtcggaaactatgcgggtaaaataaatctgttcttcctgctgcatcgttccgataatataattactgaactctctcaacagacggtctcccatctgatatccccatttctggttaaaatacttaaagttctcaaaatctgtgtataccatcacataagaactgatactgtcattagcaagcactcgttctacttcttctttaaaacgggtaaaagaaatcaaaccggtcaaatcatcaaactccggatttgtaaacattccattactcatggaattcattaaaaacaattttccaagatgtgccgcaataatttttgtaatttcacctaaaatctgccgttcttctttcttccaactgcgtttttctttacaaaccatataagaaaccgaacctgcatatttcccctcataatagattgcagtatgcaccgctgttttggcatctccatgaagcagagtttgaattccatgttcactataaccaagtgatttcatctcgtcttcctgaagcactgtcgttccattctcatcataactgtaaaataattttaagaaatcctcttttttataatttattttctgttccaatgcctgcggtacattgtccgctgtccactgatacatcttctcgctcatattaaccttaatatccgtacgaaacacagtaatacgatctaaattaaaacttttacctacaatttctaataaactgtttactgcactgtcaaagtcacctgctttttcaaatgtttcaaatgccgttgccaccagacttcccctgtatccggatatcggtctttttcctcttctgtgctcttctattttttccttcttttcttctacactttgaaagcgctgaagactatcacaaaatacatactggtctcttccgttttcttttgcacggtataacgcccagtctgcattttttaatatctgttcataagtatatcccgaaacattttccggaagataacacactccaatactacaggtcatagagtattctttttcctgaaaagtctgattccgaatcgaatgaactaactgcatagctttacgaaccaatgctttattgggaatatctttgaataaaattacaaattcatcaccgcctgcacgcattacaacatcttttttatcacagaccataagcaacaattttgccaaatcctttaatacaacatctccaaataaatgcccataattgtcattcacatctttaaaataatccacatcaataatcatcagaccacaagcggaataagggtcttttgttcttagatatttttcaattaatttcgttcccgcccttttattataaagctttgtgagtggatctctctgcgcttcttcctgcagttgctcttcccttcttctctctatcgtaacatctctgatacttcccagaagcaccgactcttcattcagactttttggaagataaaccgaatttaaattctttcttgaaatcaaaccttccccctctacatatctgatttcaatcgaatttcgtacttctccattgcaaaatcctaccattttccacttatcttccggatgaattttatcttctttttgcagatattccataaaatgttcaattttttgaagcatctgaaactgaccgtcatataaaataaatacttccctttccgggaaatattcaaataataataattcttttcgttttatcatagaagccaaaattgcctgcctgtgttttaccctcataaccgcttccgtatctttgcattcacctttcatacctcttactccctatattttttatatccatactataccgctctcataccttattttaaaattataccaattttttttaattttgtatactagccaaacggcttgtattctgttttaaactgcgttttttaaccgaatcaagcaagtccctgtcagtaaaaaaaagatgactacacaaaatttaaagtgtagtcatcttctgtctatttcttatttttctataacgtattttagtttgctgcaagctctaacattctctttaatggttttcttgctgattcacgaagttcttcatctaattcaatttccggtgccattttttcaagactttctaatacattttccaaattcacttttttcatatttggacagaactgacgatgtccgactgaatagaattttttctctggatttttctgcattaattcatagaaaattcccatctctgtacagataataaagctggttttttctgaagaagttgcataatcaataatctgtgaggtacttccaataaaatctgctacagaaagtgtatccggtgtacattccggatgtgccagaaccattgcttccggatgtacttcttttgcttttaagatatcttctttatgaatgctcttatgtacatgacagaaaccgtcattaaaaataaaatgtttgtccggcaatttttctgctatatggcgtcccagattttcatccggaataaagaaaatgtgttcatttggaagcttctttacgatcttgagcgcattagaagaagtcacacagacatcagaatgtgctttaatctcagctgttgaattgacataacagacaactgcaacatccgggtactgttctcttacttctttaattttttcaacatctaccatgtgagccattggacaatctgcactggactctgccattactacttttttctcaggatttaaaatctttgcactttctcccatgaatgaaactccacagaataaaattgcatcttcagatactgttgtagccttttctgcaagataataagaatctcccacaaaatctgcaattgcctgtacttccccatccacataatagtgtgccagtattactgcatttttctcctttttcagtctggcaatcttttctttgatttctttgttgctcatattccttccccttttcatttggtttgatttttaaaaagcacaccaaaagcgcactttcttattattactcttcctgactgtcactctttttacttccgcgcaaatcataatcatccagaaaattgtaagcttctttgtctttgtgataaccgataaccgttcttaaatttatattacggacactgttaaaaatattggtttcgatcacatcgctggtctttctaaactgcgcaaccagttctttcatctcatcacgttttgaacctctgcctccgccacagctgacgcagttttctgtaaaacgacatgcacactggataaaatgcagtccgttgtaatctctccatgctttaatcgcatcttcttttaccatgtataatggacgaattaattccattccctcaaaattctggctgtgcagcttcggcatcatggtttctacttttccgctgtataacattcccattaaaatggtttcgattacatcatcaaaatgatgtcccagtgcaattttattacatcccaatgcctttgcatgagaatacagatagcctcttctcatacgtgcacataaataacatggatttttttcgattgttgctacagtgtcaaaaatttcactttcaaatacggtaagtggaattccaagtaaatctgcattatcctgaataatcttccagttatcttcattatagcctggattcattacaagaaaaactgcttcaaaatgaatttttccatgacgttttaattcctgaatcagttttgcaagcagcatggaatcctttccaccggagatacagactgcaaccttatctccctcctgaatcagctgatattcatttaaagcttttgtaaacggacgccagatggatttccgaaatttcttaataatgcttctctcaatttcttttgtcttttcttctttgctttcttttgtatcttcttccagaaaacgacttaaagaaagacgcagataggcacgatatccaccttctacattaaaagcattgtatccggcttttgtcgctgtttcaatataatccttacttctctctccggtatgacagataaagtaaattggtttttctttttccaacacttcttcatatcgtgaatcaaactcttccatcggcagattcactgcccccggaaaacttcctcttttgtattcttcctccggacgcaggtcaatcacctgaatctcatctgcacttaactgttctaattcttctacctgaattgttttcataacttcctaaatcacctgtattaaaatcatatttacggctgttccaagcaaaatactaagaaacgtattatgcttccatttataactgactgcaacaactgccactgccaaaaaatttgcgattcctgtgtgagaaaaatcactccctgtttcctttaaacaatacacaatcagcacagccataattgctaatggcaggatttttccaagataaatcagtttttccggcattttgcgttccccacgaaatgcaagaaacggcaatgcacgcaaaaaaaatgtaatccccgccgacactgccacaaccagaaaaaagaactctatcttcatgactgtgcctccttttctctcatcaaaagcagaacacctgaaacaagaattaaagaaggcagcataaagcttcttgctcctgctataatcagacacagcattgagattataagacctaaaacggccggtacatgattctttgttttctcccaattatcgataaaaataatgacaaacaatgcggtcatgcaaaaatcaattccctctaattttatcggaatcagctgtcctaaaactccgcctgcgactgtacctgccatccaataacatcttgacagaaatgcaatcacaaacatcatgtcctctttttcttttccggtttccatcaggcttaaattaactgcataagtttcatctgtcattgtatgaatcatataaagaagtcgttttcccatcttcttaaattcatctacaaacgttaaactataaaaggtctgcctgctgttcatcaaaaatgcagtcaccgcaatcgtaataatagaagttccaccacttaaaaatgaaaccagcacaaactgaaatgctccggtatacacaaccaggctgataagcagtgactgataccagacaaatcctgcttcttccattgtaattccatatgctatactgacaaacacatagctgcataaaattggaattgactttaaaaatgctttttttacggtttctttctgcataaattttatcctaaagtatcgccaaattttggttttcaatccgttagtggcatagtatcactattgagaaaccttgtcaagtgaactactctgctacaagtaaccgagcttcttgcttcaatcaccactgctatacaaatacaaaaacagtatctgcatagtcttacaatgtcaccttttatttttgaattttatattgactttttgccagattctgctagaataatgccttgtaaaattaagtagtggatttttcctgacggataaaaccgtctcttttcgccacacagcaagaatgctgtgtggctttttttatctccaaaatctgctgtatttataattcaaaacgaaaggaaattaaacacatgaatgacaattttatgaaaaccaaaccggttttacctttgcttttatctttagctctgcccatgatgctgtccatgcttgtaaattccctttacaatattattgacagtttctttgttgcaaaaatcagcgaagatgccatgaccgcactttctttagtctttccaattcaaaattttattaatgccgtagcaattggatttggtatcggaattaatgcagttgtcgcatatttcttaggcgcaggcgataagaaaagtgcaaatcaggcaacaacattaggtataattcttgccattatccatggaattctcctgactgccggaagcattttacttattccatattttttaaaaatgttcagtcattccgaaaacgtaatttcacttggaattgaatatagtaatattgtatttgctttttcactgattattatgttaaatgttggatttgaaaaaattttccagtctgtagggaaaatgaaagtaacaatgtttagtatgatggcaggctctataacgaatattattttagacccgcttcttatcttcggtatcggtccatttccaagaatggagattaaaggagctgctattgcaaccaatatcggacaacttgtctgcatgactatttatcttttgatttttattttccgtccgattcaggtaaaaattcagaaaaaatatgcgacactggattttgatttaatcaaacgtttatatgcagttgggattccggcaactttaaatcttgccctgccatccctgttgatttctgccctaaatgcaattctagcttctttttcaggagtttatgtattaattttgggtgtctattataaattacagacctttttgtatcttccggcaaacggaatcattcaggggatgcgtccggtaattggatttaattacggtgcaaaagaatataagagggtgaaaaaaatttacaaaattgtccttcgtatgagtgctggaattatgcttgccggaacacttatctgttttattattccagatgttttaatcggattatttacaacaaatcccgaaaccattgaggctggaaagactgctctgcgtatcatcagtattggatttttagtatcttctgtctccattacttcttccggtgctttagaaggtctgggaaaaggagtgcagtccttaatcatttcactctctcgatacatagttgtaattatccctgctgcttttcttttatcacgagttcttggtgcagcaggtgtctggcatgctttctgggtatcagaagcaataacggcaatcgtatctttagttatttatcaaaaaacagtaaaactaaattagacttttatttaaaaagagcaaatagccagtacttgtacttattcctgaccatttgctctttcttttctgctttttagatttgaaactttgcacctatttcttctttttctcataacatgatatcatatcctgcctaaaaaaaatgaggtccctcttcatgaattcttattgcagttctatcctttttgaccacggtccgaatccctttacaatcaatcttagaaatgctgcttcccataactgcaattcctgtactaccctctggagcggttcttctcttgaacttaaacttctaaacattctgccatggaaaacgaccggatggaaacagcatcctgaaaccgatcagatcattcgtattgaatgtggcacagctcttctgattctcgcttctaaaaaatgccatcctaattctcaaaaaacgcttcataacggagacgccgtctttattccagctggaacatggtataacctaaaaaatatcagcaagtgtccgttaaaactttctttggtacagatttcatccaataacttcaaaaactaattttatgttttttggatatcatagttctatgttctgtggtaaaatattgtaaatgtcaaaatctaattttttactgaactaggagatgaaagaacatgaaacactacattgattttattgcagaacaattaaagacattaactgcaatcccaagtccatccggctataccaaaaatgcaacggactacctgatgaaactgcttcaggacatgggatatgaaccgaaattatccagaaaaggaaatgtgtttgtaacccttggaggggacggtgaacctctggttttagctgcgcatgttgacacacttggtgctatggttcgctcgattaaagacaatggacgccttcgcccgaccacacttggcggacatgtctggagcactgccgatggtgaaaactgtaccattcatacaagagatggcaaggtctacaccggtgttgtcttaaacactgagccatccgcccatgttgccgataaaaaagtagaaacccttgaagaaaatatggaaattttactagatgaaccggtttctacaaaagctgaaacgcttgcgctcggcatccagaccggagatattatcgccatggaccctcgaacagtcattaccgaaagcggttatatcaaaagccgttttcttgatgataagctttctgcttctattcttcttggaatcgcaaaaattgtaaaagatgaatctctttcctttcatcggaaagtttctttattatttaccgtctacgaagaagtcggacacggcggaagttttgttccagaagatacaaccgaaatgatttctgtcgatatgggatgcgttggggcagaccttggctgtactgaacggatggtttctatctgtgcaaaggattccggtggtccttacaactatgatttagtaacggaactttccaacattgcaaaagaagaacagctcgattatgcgattgatgtctatccgcattacggctctgatgtagaagcaactcttcatgccggttatgatatccgtcatggactgattggtcctggagtttacgcttctcataactatgaacgttctcaccttgatggtgtaaaaaacacatttttattgctaacgacttatattacccgataattttttaaccaaatcaaggaagtcccctgcttcaattgccaaaagcaataagcaagggtcgggacttgcttgtatcaggagggggcaagccccttctgataagctgcgtagcagctatttggttatgagcaagtagcgaaagcggattgcgaatatccgcttgacgtattcaaaaatccgcagccaccggaaagttaaacttcccagtaactgcggattttttcttcgtttagatgttccccgattacaatctgaatttcctgtccctgaggaatcggactgatacaaagttcatcctgcgttgcatttaattcaatccagcttccatcttgattctgactaaatcccttgatacgaaataccttgccacaagatgcatcttctaagatttttttcacctgtgtttttaaagtctcggcatctaatttcacatccataaaataaagagattcaaacccactttcctgtgatacatccctcttttcataagactcctgaacatatccggcttctgcaatctcggaaaaatcatcttctgataattcactgccatctcttctcataagcatctcatctcctaaaattcgattgcactgaatctctttcaaagactgatttaaagtggcaatagttgtattgatttcttctttcgtcgcttcttctgaacggctcaaaataatctttccagcatgagcagcttctgatgccagaagataccttgcttcctctgataaattcttctctgattttgcatttacaaccgtaatcacacttccgatttgataccatttatctaacggttcatcacgaagcacatcaaaaaattcatccacatcataaattccggaaggctctactaaaattcggtcataaccacacattcccattgcaattaattttgtgcgaaaccgtcttctatgtgtctctttatcacagcctccggctatcatttcgagttcacatttttcgccctcaagttcctgtaacagcatcatatctacattgacagcgccataatcattttccaaaatcccgatattaagcccttgacttattaaatattctgcatatttttttatgaaagtggtttttcccgagccaagaaaaccagtaattaaatcaattgtaaccatatttacgatcctcctttctttgttcctgatacatctttttccctcaattttcttcggtttttcgcatatcattctatcatatttttttggagcagaccagatattctgcctgaactttttattgactttttttatcaatcagcgtaacataagctaccgaaaaagaattttttaccaattataaggagaatgatttaagaatttatgacaacaatgaaaacgcaaaatcccctcggttatgaaaaagaatccaaattgcttgtcaattttgcaattccctgcattatctcaatgctggtgacctccctttataatattgtagaccagattttcattggacaagggattggcatgctcggaaatgccgcaactaatatcgcatttccgctttccactacctgtaccgcactctctcttttactcgggatcggaagtgcaactaatttttccctgcatttaggggctggagaaaaagaaaaatctgcccgctatgccggcaacggaatctttctgatggcagtattcggactttgtctgtttcttgcaactacactttttttaactccaatgttaaaatttttcggtgcaaccactgaagtcctgccttatgccaaacagtacacccgcattacagcctttggttttccatttttaattgccaataccggaatgagtaaattaattctggcagatggaagtccacgatattccatgatttctatgttaatcggtgcgattgtaaatacaatccttgacccgattttcattttcggtctgcatcttggaatgaccggtgctgctcttgcaaccattatcggacagattgtttcttttagtatcagtcttcattatatgtttcactttaaaaatattgtgctgaatcgaagctgctttcaaattcagctgtcttactgtaaagaaattttccgacttggcgcaagtgcctgttttaaccagattgccatgactgtcgtacagattgtaatgaacaacacactggcacactacggggcaaaatccatatacggaggtgatattcctcttgcctgtgccggaatcatcacaaaagtaaatatgatttttatgtcctttgttattggaatttcacagggtgttcagccaattatcggatttaactatggggcaaaaaaatataaacgtgtacgaaaaagttatctgcttgcgcttggtgttgcaactgtgctttccggcattgcattcttctgttttcaggttttcccaagacagattatcagtgtattcggtgagggaagtgagttatattttcagttctcagaacgttacttccgaatttatatgtttttaaccttaatcaatggaatccagccggttacttcaaacttttttaactcgattggaaaagctcaactcggtgtctttatgtcactcaccagacagattttattcctgcttccattaattattatcttcccactttttatgggaatcgatggtgtcatgtatgcaggaccgatcgccgatgcagctgcggcacttgtctgcggctattttaccattcgggaattaaaagagttgacacaattggaaaaattaactctgaatctttaagttcatgaacaaaaaagcttgtcctgaataaattcatattcaagacaagctcattttaaactaaattttaattgactttacttcattttcttttcatttcagttttgagattaagataacggaatataccgataataatgacaactgtttcctctcgtttccggtccggcttcttcataccagttatactcaatttcttcgttttcgtctgcccaaagttccggacaatccgtatactcccaatccaccggaatcttatgttcttcctgcaaggatgcttttaacatcatctgatgcagttcttctttttcggtttcatttaatacacccggttttgctgacacaaaaagtgatgtaccggagcgtgttactaaatctgcccactgtgaatttaatttccacggaatattttccataattccaacgcagtctgcatcaatatcaaaaaatgttccatgctgaggcagacaaaatgccagcgtattgactcccatcattttggtacgctcccaggtttttccactggtatcatccccggttctctgcatgtgcatcaaacctgcacccagatgtccaatcgtattgcatcctaaaatcatcacatgatattctttggctgtctcataaattgcacgatataactctactacaatttcagcacttgttttggatttatcataaaagctccagccatccgaggttgggaacggattcatctcaagtccccatctgccaaataaatcaaaggttgtaaaatcatgtttgattaaggtatatccccactcgcagattcgtttgacatcttctttaatataagcaagcgcctccggatgtgacgggtcgagacagccgttgtgagaaattctccattcttccggaatcgtctcttcctcatttaagaggaaacgaacccagatacccggacgtacccctttttcttctaatttttttgcaagtgctcccatgtccgggaatttttcatttccttttttccatggtcctccattgtattcatccagccgatgatgttcctgccagcaatcgtcaatgaccatataaggacggttttctgcgccttttgtaatgtctacaatataatcggtatcctgtaaaatttctttctctgagctgtctccatatgcataataccagttgttgcttccatagaccggaaaatccggaaaaatcggatccgtgcacatgcatttacaaaatgcttttgctgcttcaaaagaggtacaatcatctgcctgcattgcaaccacttcagctgctaacagctttcttcctgaaagtacaacccccgttccaccacagcgtacatccaaaactaaggtaattcctcttgtatcagcctcccagaaacacatggcagaaggacgaacttttacaccatatcctgtcacgactccttcatttaatgcaagaaaataccaaggcataaagcgtgttccgctcattcccttccattctgcatctccataagttctctcccagactccgccaagaatctttgacgtacgctcaagcggagtattccagcgaagctttactgtttttaccggtgagttatctgccgtaagccagatttctccattttcatttgcttcaacacaaatatcttctttttcaaattttgaactgttttgttctccaataaaagaaccttcttcactctctactgtaatataagatggtactcctaattttatttctcttttcttcataactttttcctcatcatatttctccatgaaatgcaccttttcggttttcaaataccaattcttcttttgtctgacgaaacgctttcggacttatatttgtatagagccggaacattttcgaaaatgcaagctgatccggatatccaactgcctctgccaccgcattaatcggcatatctgtattttttaacagattttttgctttttccatccgaaattttaccagatattcctggggcgaacatccaattgtttttttaaacatattcgtcagataactgcgattaatcccgatatattctgccagctcattaatctttattttttctctgtaatgatgttttatatactccattgcatgttctacatatacagtccccggataggtatgctccggcatcgtttttgtattaaatttctcattgtcttctattaatgtcgccagaaacaaattcaaatacccattcctacgcatcgattcctccgttgtaagtcgatgcacttcaagtatctcatccacatacgattttaaaagtgctgtacattttaaacttcgaattgatttctcttttgaaaatcccgcatactgcattactttttttactttataaccatacagcccaatccatgcataggcccatggctctttcttatccgcttcataccaggcttcttcttccggacaaagtaaaaaagcatcgccggttgttagatgaaatacttcaccattcttttccagcttcccttttccatttgtaataatatgaagcacataataagtccttttgtttggtccaaaccgatgtccgggataacatcgctcccatccacaatatccaagacttaattctgccgaatcaatcggcaaatcttccaggcatttatatctcccctcattcgtatatgccgttacctgtgtcatatcacacttcctcttttttataaatgtgatgcggtaaagtcaccttttacagttcccaattgaagttcttcttttgcttttcgatattcttttgggctcactgtaaaattctgtttaaatatctttgaaaatgcaagctgatcctgatatccaaccgcagctgctaccgcattaatcggcatatctgtattctttagcagattttttgctttttccattcttaaattcaccaaatattcctgtggagaacagcccactgcctttttaaaactgctcgtcagataactacggtttaccccaatgtaatctgccagctcattaattttcaccttttcctgataatgatgtgaaatatattccatcgcatgacgtacataaaccactccgggataagagtgctgctgtgctgctggttccgtcttcttataatcttcaatcaaggcagcaaaaaacaacatcagatatccatttcgtttcagctcatcggtgtaggaaagctgatgtgccgccaaaatcccatccagatactgattcaactgttctttacattctacatgcctgataggatttctcctcgaaaatcccgcatgttctgcattttcttctgcacggtagccggtaaatccaacccacatataacaccaggggtctttcttatctgcttcataccaagcttccacttccggggcaatgaaaaatgcatcgccctctttcaactcatatttatgtttattaatttcaagtattccttttccgcttctcacaatatgcagtacataagacgtccgaagattcggaccatacttgtgtcccggattgcagtattcccaaccacagtaaatcagacacaaatctgctgaatctttttgcaaatcttccagacaacgaaatctggcagaattggtatatccggctacgtgtttcattctttactcatccactttctttaaggtatacagaagtgatgcaaaatctccgccttttttattcaattcttctctgtcaattggaattccggcgctcatcaactcatcaccataagcctgataggtttttacactgtcttcctctgttttatgaccataagcttctgcaatttttgcatcataagaagtaaccggtgccatatcgcagctcacttcatattttgtattggcatcaagtccatccagttttaaacgaagccaggacgcattgactttatttaatctctgatagaatgcagccaccgcctgtgttttatcgctggaaactaccatccatgcagtttcatttccttcaaacggactcaacagacgatagaaatcaccatccatttgaattaactctctgtgttctttcataaatgcaatctgtttctttactgtctcaatttcggcatcgctaagtaagtttaaatccagctcataaccaaatgttccaaaataggcaacatttgctcttgtctcaatcggagtaattcgatgcatctgatgattcggaactgctgaaacatgggaacccatactgacaatcggatagacataagaggttccatactgaatctttgttctttcacttgcatcggtatcgtcagagcaccaggtctgcggagcaaagtataacattgcaggatcaaatcttgcaccaccacttgcacaggactcaaataaaatatgcggaaattctgtcgtcagtctggtatataaatcataaactccaaggatgtatttatgcatcacttttccctgctcacaaggcgcacttcctttgctgtaaggttcagacatatagcggttcatatcccatttaatataagaaattgaagattcgcggattacttttgcaatcatctcataaatataatctaccacttcgtttcttgagaagtccagtacattttgatgtctcgcatgagactcaaaacgatttggtgcactgataatccagtccggatgtgcacgatataaatcactatccttgttaaccatttcaagctctacccaaagaccaaattttaaccccagttcttctacttttttagagagccccgaaataccatccggcaatttttccaagtttacataccagtcaccaagacctctgtaatcatcatttcttgcaccaaaccatccatcatcaagtacaaataattctacacctgcttcttttgctttttttgcaattgttaaaatcttttcttcattaaaatcaaaataggttgcttcccagttatttaataaaattgggcgtgccttatctctccattctccatgcatcagacgttttctgtataaacggtgataggtctgactcattttatttaagcccttatcactgtaaaccataacaacctccggagtctggaagctctctccactctttaattcccagctgaaatcttccggattgattcccatcatcacacgagtcatatcaaaggtagaaacttcaacctgtcctaaatagttaccgctgtaaaccaggctgaatccatagacttctccctgactttctgtcgtatgtggacgttttaatgccaaaaatggattatgctctgcgccacagcaggttccatttaaactctgaatactctggattcccatttccagctttctgttttttacgtaacgctcacgtgaccatccaccggaaagctgaaccatttcataatccatatccaaaaattccacactggcactcatggcacgttctaatacaattttttctttccctttatgtacaaacttcgtatttcttgtaataaccggatacgcctcataaatggtataagacaaaatcaaatcagtatccatcacgttatcatgcagagtgacttcaagagtctctgcttcctctttttcctctacataagttgccggaagtggaaggatttcttttttccctgaatagatttcatgacctgcatatttaaaatcaataatacggcttccattttcctgtgcaatggtcactgccggacttctatagtcaccggttccataacttggatattcctgtctggtatactgcatggataacagacccggctccggaatacaaacagacatctgagaacgcattgcttcatcatggaaataagcaaagtcttctttgtcatggattttctttccataatataaattttcaagctgtccattttccataatacgcataatataacttacttcattgttgtaaagatgaaaacatttgctttgtttgtgaaaaataattgccatatcttttttctcctttttctaaaaagaccgacgtagaactctacgtcggtcttaaattcataattaaagttttccaccacttgttgcaataccttcgataaactgtttctggaaaattacataaagaacaatcatcggaatacatgcaatcagagaagcagccatcagttccgggaacttcgcagcatactgtccctgcatctttgcaagtgcggaagaaagtaccaacatgtctttatccgtatttacaatcatcggccacatcaaatctttaaatgcaaacactgcggtaaagatgcccagtgctaccatactggatctggtaagtggtgccataatgtataagaatgtctgtccgatattacatccatccagacgtgcagcctcttcaagatcatttggaagtcccatatacccctgacggagcaggaaggtaccaaatgcggtaaccatacccggaaataccagaccaaaaattgtatttaacattcccatcttacttaccataatatactgaggtgagatgaaaatctgtgccggaaccatcatctgcagcagtactaaagagaaacagaaatctcttcctttaaaatgcagacgaccaaacgcatatcctgccattgtcgcagttaacactgcacaaagtacacggaagaaaatcattaacagtgtatttttgtataatacaaagaagttcatgttacgaatgacttctttaaatgaatccgttctccatacctttgggaaaataacaaacggatcgacacttgttgcctcagtaactgttttaaacgcggttaaaatcatccatataaaaggtaccagcatcgtaatggatacaagaatcaagattacatggattaaaactttcgtaaagttctcttttgctttcatgttgccttccatactgcttcccccttcctagttgtagaatacccattttttctgtgcagtcatctggattgcagtgataatcaaagtaatcaccaaaagcagaataacaattgtagaaccataacctatgttcttatttgtaaaggtatatttatagaataagaatactaaggactgtgttttattaagtgccggatttgttttatccataaccatgtagatcaaatcgaatacctgtaaagcaccaataatacgtgtaatcataacaaaaaagatggttggggataacaacggcaccgtgatattgaagaaacatttgattcctgttgcaccgtcaatctcagccgcttcataataatcatgcggaatttcctgcagtccagaaataaacaataccatgttataaccaatgatagaccagataccgattactgcaattgaaaaaactgcaatccttgggtctgaaatccattttgtatgtaaatgaaacagattgttgatcagaccaaaatctgagttaaacagccatctccaaaccatggcaactgctgccggagctgcaaccatcggtagaaagataatggtacgataaacagaacgtccgatcatctttcgatttaagaacacagccagtaccagcgcgataataattgaaaatggcacttctacgattgcatacttaaatgtattaagcaatgcctgccaaatttctttatcggcgaatactttctgataattttcaagtccaacaaagatatttcctcttccgaaatctccggttttaaagaaactctgataaatcgtctggaaaatcgggataatatttaatacaatcaaaccgattactgtagggagaataaaaagccagccccagataaattcacttcgttgtcttccggttgtttttactttcgtcttacctgccaaaccactcactccttttttaatacaggcagattctttcgaacctgcctgtgtctcttgctttcattctacttcgttacactataaattgcgttacaaattactgctgttcttcagccagtgattcgttcatctgctctgccatttctttgcaggcatctgccatagttttgtcaccgctgtaaacactcttaagaatttcactattcttgttttcccatgttactgtagaacgggagtatggtctgatctccatatcatccatcatattgatgtaagcctgaagattaaagtttgcggattttgcccatgcttcagatgttccggtataagcagacattgtaacacccagttcagcctgtttttcctgtgcttctttcgaaccaaggtattcgattaactgccatgcttcttccggatgctcggtatttgcggatgctgcccatccaagaccattgtaaagagaagctcttctgcctgttgttgcgctctttggaagttctacacaatcacagttctctgcggtgtattcgttatcacggaatgttgcgatcatccaggagccctgtggaaccattgccactttaccggattctaataatacatcttcaccgttttcagacattgtctcgattggaggaagcacaccgtctttgatccatccttctaacatttccattgcttctaccgtttttggatcatccattccggattttgttttgtcatcattgataatatatccgccattatcatagatcaggttgtagtaaccagcctgattgttatcatttctaagacataaaccatactggcttccatcgtcttttgtcagcttcttcgctgcttctgtcacgtcatcccatgtccagtcagcggtcggatactctaatccggcttcgtcaaacatttttttgttataccataaagcaatcgtatcgatatcttttggaactgcgtaatatttgtcatcgtatgtatacagtccccagatatcttccggatagtttgcagggtcaatttcactgctctctgcaattttatcagtcaaatctaataacatgtcatttgacatataacgctgactttcgttagaatgcatccagaatacgtccggtaaagaaccacctgatgcaccagattccagaagtgtccagtattcatcccattttacaacagaaactttggttttgattccagttttttctgtgaaatcattcataatttctgtcaatccaggttcctggttggaatcccagattgttacggataattctacgtcccctgaatcactctctgattttttgtctgagctgtcgcctgaacttgagtccccgcttccgcatcctgccatggtaaataccattgcgcctgtcagtaataatgccattgcctttctgaatttcataattttttcctcctttaatgaaaaagaatattctctataagtagggttgcttcgtccctcactcatttgatgaattcattatatcgagatatgtcaaaatgtaaaatggaaatatgtttttaatatatggagaaatgttgtttatttgtgcattttctatatttttttgtcttattttctttttcaacagtcatttttatatttatatgtctggtttttcacaattttattcggtgtttttccaacaaagctctctttatatttccgattttgctttcatttttccacatatacataacatttttccatatccttttctttttatttgtttttaaactatatttatattcaaaatacccgatatctggaatttttcttttttattttttgcattttgacatattcaatgttaaaataaggtatcgtgcaattttacatcacttgattttttgacgaaaggatatgattttatgaattttatgaaccaggacaacattgtcgtaattgccttaaaccggattggagatgttatcattgcaaatctgctttttcttctctgctccatcccccttgtcaccatcggtccatcccttactgcactatatcactgcatgttacgtatcgtaaaaggaaatgaagacaaggttactaaaactttctttcgggcattacgtcagaattttgtgcagtctttgatcgcctggcttgcacttgttatcgttggtgtgattttgtttttgaacactcactttctcctgcagaatacttcagaagccggaaaaatcttttattatctgtccgggctggtacttgtactgcttgttattatcgcactttacatctttccggtcattgcggcattttccaataccttaaagaaccttgctaaaaattctgttatttttgcatttatgcatattccgtccaccttgttaattgcagttatttctatcctgccaatgtatatgacttatcaagatttaacacttttaccactctacagctgctgctggtttttcttcggctttgcattaacctgctatattaattctttcttgttttatcggatttttaaaccgtatctggaaacaagcgaagaaaccgaagaaataaaagaaatctccaaataaaaaaatttccgaatagtaaaataccgacaaatgaatttttattctcatctgtcggtattttactattcttcctcaaattcatctcccacatctttcccaaggtcgcaggtataacgccattcaattacatccccgtcactgacctcatatttggaacatccataattgggaaaatatccattcacgctgtaagtccatccagaacgttctccacagtcaaattcatacaactgattaattccttttacataatacgcagaataaagcggagtatagtttgcatccagctgaatttttttctctttacagacacgcgcaagtatatcatagacggtatcacccgtttcatatttcacctctatcggttctaaaatccagccatctgacggaacaaattcctttttcgatgcttttaactctttctcattatccaaaatagtagaacattcaatggaaaccgtacatttattcttttctacattctgtttatttgtctgctgtttctcttgttgtgtttcttttgtttccagttttgtaatctcactgctgtttgtcattccaccacagcttgtcaaaagaaaaagaagtgtcagacaccctaagatttttctaaatttttttctcatcctttaatcctcttctatcattccatacttcactttgattctctccagtttttcaatcatcggcttacttgcaatccacaaaaagattaccgttgctgatgcatgaaccaagtccaccggaagccctgacatataaattgccagcagatttcgcttggtaattgcataggaggtcatcacaagggaagccgggttcatgattcctccatagataaacacggtcgctaaaaatccataaatacaaagcgaaatcttacgtgctttcaaccagcctttttgaaataaaatacctgccaaaaatccgataattccagcagcaaacatctgccacggagtccacggtccctgtccaaagagcatattcgaagaaagcatggaaagcgcaccaactaaaaagcccgattctgcaccaaagcagacggctgaaataatggtcacagccacaaccggtttaaagcttggcaccataaaaaatgctgcacggcctgcaactgcaattgcaaccaaaaccgcaattgtaagcagttctcttgcctgcggttttcttccttcaaaaatcaaaaagaacggcagcatgcagtaaactgcaatcgccagactgatgacaaaatattttcggtcatcaaaaagcgtaattccaatccagattgtaaccggaattaaaattaaaatcaaaaacatagatgcaatcgtacgttttgacagctttcccttgtgttttggcgctgtcagtacatcctgcgcttcccagaaatcgtttttttccggttctgatttctcatcccagaaatccaggtctgtttcctgtgccggtttcttcccatctaaaaaggcatccagaaagacatctaatttttcttctttcagcacgacaccgcctcctcttctgtctgattgattgcttttaccacatcctctactgttaccgcatttggaaaataatttcttgccatacggtttgcagcagtggtataaaagttatttccggcaaaaaattttttcgattcttcactggttaccacatttccctgaaagaacagtccggtacgatccgcatactgcgcacaaaattctacatcatgagaaatcatcaaaatcgttacaccatgttcacttaattttcttaatatctctccgagttcttttttataatgattatcgattcctttggtcggctcatccatcaaaagaattttcgggcgaagcagaagtacttttgcaagtgccagtctctgctgctctccaccacttaaatcatagggatgccggtctaaaagcccttctaatcttgttaacgagacaattccctcaactgcatcttttttcttcatttcaattggatatgcctcactttttctttcccgttttccatctatcacttcatataaatcctctcttacggttttcttcacgaacagactttgcggattttgcggcattactcctaagaacccatgatagaggtcatcatcactgtattttccgatttctttgccttccagatagattttaccacggtacggaaaacgaattcttgcaatcagactcatcgctgtactttttccggttccgtttcctcctaccactgcaaagatttctccttttttgatgtccaggcttaacccttttaccacatccggcaaatcccgttcatagcgaaaccagacatctttgattcggatttccggaatttctttttccggttcttttttcagacctgaaagttttccaaaaatagaattcttcttttttgctgtctcttcctgatttctttctttttttatttttataccttttgtctctaattcctctgacagccagcgtcgtccctgactaacggtaagcgggcatcgaagggaactgtttattccggcataaatctgcatcggtgccggcatggaaagaaacatatcatgtcccattgttcttaactgctccccaatttcattcggtgttccgtctgctatcatccttcctttatccatgacatatactttatctgcccatggaatgacatcttctaagcggtgttcggttaaaatcacagtagtcccgatatcacgattaattttccgaaccgtctctaaaaaatcggaagctgcaattgggtcaagttgggaagtcggttcatctaaaatcaaaagtttcgggtgcattgccataacagaagcaagatttaagagctgtttttgtcctcccgataattcactgacattttttaaaaaccaggaatggattccaaaataagaagccatctctgccacccgaagccgaatcgtaggcgtatcatagccaaggctttctaatccaaaagcaagttcatgccagactttatcggttacaatctgattatccggattttgaagcacatagccaatttctgcactttgtgtccgcaaatccacgtcttccagattctgcccgccgtataagatttctcccttcttttctccatgtgaagcaagcacacttttaaactgccgaagcagagtgctttttccgcatccactctttccacacagtacaacaaacgaaccttcttctacttccatggatacctgataaagtgccgcatggctttcttttggatattgaaaactaaagttttttacttcgatacaattcaattttttataacctgctttcttttatttttgacgctcacatcatttttttcgggtctgtcaaataccatggaagcctgcgctccatatctgccatttttttaagtttctcaaatcttctatcctcaagcacacctaaaatcacaggaaagaaacaaaatcccgcccatgccacataaataatgacgctaaggggggtcagcggaagtcctccgattttaatctgtgggtcgtactgtgcaaagctaatgcctgctgccattccaccaaaatacactcccatcagtgccagtaaagtgcctgttacaatcccatccctattatcaaatcgaaagattgcaaaagcgcttctcccttttaagccatatcctcttgcacgcatcgaatctgaggtatcaatcgcattttccagtgcccaggtaaccaatacagaaaaaatcgtaataccgtgacgcattttcttaaaaatgtttccgttctttacatctctcccaattgctttttgtccatttcggatgacggtcagctgctgtccaaatctcggcacaaaccgaaataccatagataataccaaagaaagtgccggaatcacacgaccaaacagatacacaaatttatctgttgtcatcactttgttgtaacaggaaaaccatagaatcgaaataaaaagcatcgatgccagtaccagtccatatacaattgcctctagcgtaaccggcccggtttttaaataaaatagcatcgtcactccataatgattaaaagcaggattaataaatgccacaattatcattgccggaagtgttgcaagcagattaaattttaatactctctgccagccttgaagtctggatgcataacaaaatgctcccaggaacgaaattcccagaaaaaccggatggctgttcaacattgttatcaaaatgactgctgcaaaccagaaaaagttcaccgccggatgacaatctgaaaaagcatcccctcttttttctttcatcttttgccctcttttcatttttattttcaaaaaactgctttcaaaatcaatgaaaataaaaatttatcgtacaaaaaatttgtttccgtctatgcctgcggaaacaaattttgtgttttaatctccaaatgcctgtatcctggctcgcagttctaacctacttgctgcccttctcagaagaaatttcttccaatggattcgcagttttcgtcctgattacagtagggataaagtctgttgcggaatctcaccgcacgttccgaaaatcatccgattttcatgcatttgtactatcgattcatttattttatttcattgttttgttgaattttgtcatatttctttcatagtacgctttatcatagagtttgtcaagcggtctttctttccccaaatttccggttatcgctttgattatcctaccagcgttccatcctcgtattttccatctttaaacgcgaagaaaaattcaaagaaatcatcggtttcataaatttccattagttcattcaaattccaaattggatttaaagatgaaagtttttcccgttctacccagaacaccttcccctcttccgaacttttcaattctcctgtaaattcatccgtcttatataaaagtacaagataccttgtcccatcctcccgaatccagtcttttatcccgcaaagctttggatttgaaatgataagaccggtttcttctctcatctcacgaataacggaatccttaagagattctcccggctctacatgcccacccggaaagataattcccttctcattttctccgagtattttttcctctaccagaacacgtcccttctcatcatagagcatacacatgttggctaattccattggttggcttctatccattgcattttcctccatttttgcagatttctatcaaaaaatataccatatcaagtatctcttttctacatcatttttacttttttgtatatctctttctccatctgcatatactatcagaaaccttagatactgcgaggattttattatgactttaaaaacaaatatttatcggtttctttttatttccattctcggcactctgcttcattttacttacgaatggtcacaaaacaatgccattgtcgggcttttttctgccgtaaatgaatctacctgggaacatttaaaattattattctttcccatgttttttctgactctttttgagctttttttctttcgagataggcttcccaaaaactttttacaggtccgaacctgtggaatctttcttggcatggggctaattgtagttgtcttttatactctgcttggtgtgattggaacatccattgattttctaaatatcgcactgttttttgttgctgttttcttcgctttatggagcgaaaataagcagtatagaaattcggaatcaaagaaagaaacttcttctaccgcattttctatcctgcttatctttaccctgctatttttcgtgtttacctttttaccacctgatattggactgttttgggagattacaaaagtttgctaacttctatttctttctactttctttctactttctttcgatacttcccaatcctcttcatcatctcgtcaaaatctatcggtttcgacaagtgctcattcattccgcttttcttacttgccgcaatatcatccgaaaaagcatttgccgataccgcaaagattggaatctctctggcatcttttcgctccattttccggattgcttctgccgcttcatatccattcattcttggcatcatgatatccatcaaaatcaaatcgaattccccaatttctgattttgcaaataactcaactgcctctgttccgtcttttgccggagtgaccaaaactccttgttcttccagcatataagtctctatttcaagatttaattcattatcttcggtcaccaaaatatgcattcccgaaatagaaatctcttcttccctcttctgaacttcttctttttcagcttcataggttttgtcaatttttaaggtaagctccacagtaaacaccgtaccttttccctcttcactgacaaaatctacttttcctccaagcagatccacggtcttctttacgatagaaagcccaaccccgcttccattataagtggttctcgcagtcttatgttcctgtgcaaaaatttcaaatgcatgtttttgaaattctttactcattccaattccggtatcccgacagataaataaaattcttgcacattctccatcggattccatctcccgacaggaaacctgcacaagccctcccgggtgattatattttactgcattgctcatcaggttctgaaacactctttggatgtttagagggcttccaagcagatagcaatgttcattttcaaccggctcataccgaaattcaactcctgcatttttcgcctgcacgaatacaattgttaccgcattgtctaaaatttccttcaaattaaatgactcatttttactttccatttccccggcttccattttactcatatccaatatgttatttaccaattctaaaaggaaatccgaggcggtataaatcttttcaaaacagtctttcatgcgagaaggctcttttacacattccagtccaatctctgccattccgcggattccgttaatcggtgtccgaatatcatgactcattcgacgaaggaaatctgtcttcgaggcatctgcggttgccgctttttctgcactgatacgaagctgttcctgataatccatctcctttttcttttgttcactgacatttcttataagaagcaacaccgatgtctgtccattttcatcatcacgttttttagaaactaatagcatctggtaccattttccggtaattgcttcaatcgtacaacctaaaaagttgcgctctttcattctttctgaaagtgttgttaagtctgtaaattccaaaaaagtctctcttgccgattcaagcatcagtttccgcgcaaattctgtaagcatcttatcggcttctttaattccggtaattatttcttttaattgcgaagtttcaacaaccggctcccaggtattttcttttggatacaggattaaattcacatcataaatacttgaaattgcctgaaccaaataaaattctttctccatccgattcattttttctctcttctgagactggacaaacaataatacaaccagagcaaaaatcagatacacacctgctgcaatgccaagcgtcagtaacatcctcggataaattttctgagcacggaaaaacacatacagataatagtttcggtacatatcatgttttccaaaccaagtttttccctcactttttaattcaatcagattttcatcctctggagtttggtcgttctttaaaacacttgaaatcggacactcagaaatcgaaagtccttccagttttcccgcactgctgctgattacattttctccatctgtcacaacaagcacttcatttttattctgcacaagattatctaacagattactaagtgagatttcgtacttatcatcttgaaacttcgttgtatcgtaataacagataatgattccagactcatcaactcttgaggcaatagcatattcataactctttccatctacttccacactgtcagcaaaaactttttccggaaactgtaagacttcttttacctgagaatcctctaaaataagttttaaaaatgtctcattttctgctttatctaattttacattttctgccacctgcaaattttcatctaataaaatcactccggaaagatactggttttcggcctgctctaacagttctgctttttcttcctcttttatataatatttcagcacattgattttattaatcatatcctgtaaatctttagttgtaattcccatctcataatccagatatttttgacaggttgtttttgcaagatttaaggtgcttgatacttctctttcaattgcctttttctgatgcctgaatgaaagcccaagcgttaaaacaaatagaacaattcctcctaaaattagcccaagcagaatatacttttcactcggactgctccttcgctgtttctgtttggtcatcctccgctcctccatatacatttttttctacatctaacccatatttttctacaattttctccattgtcccgtccttgcgcatttccccaaatgcctcattaagtcttcggacggcatccgcatctccctcttttcgaaatgccactcccacagcttcacttcttagactcatatttaagaaacggtactctcccggatattcctccgtatacgtctgtaaagcgccctcatgtccaatgatggcatctacatatccttttcttaacgacgtaaatacttcaccaagttctcgaaaacaggtcaactgctctaatttaggaaaatttggattcatctgttttaagataatcttttctgaggtagaacctgcctgtactcccacacgcttctcttctaaatcagcaagcgattgtatcgtactatccgaacgaactccaaccacacgctgtgtataaagataaggatttgtccataaatatcggttttctcttccctctattgtcagataagaccacagacaatccaccttcttattttccagttctacaaaacgatcttcaatcggtatcatctgaaaaacaggtgtatatcccgctcttttacacgcctcctttgccacatccacatcgattcccgaataatttccattaatatcctgataaaaataaggagtatacgaagttcctccaattatcagtcctggaaaaactgcctcttttttttgttttgttccacacgcacagacacctaaaatcaccgcaagtgccactacaagtaataccccttttttcctcatagctgttcccctttttacttactccagaatttcttatgtcactattaattttttatattttcctcacagatacgtgtcagcttttctttaaaaaatgaaatcatcctctcccatacttcatcctgaaagaactgtaaatccgcatggtctgctccttccagagctaaaaatgtcacatcacaaccatttttttctaagctttcataaagactttcactttgtgaaaacggcacagtacgatcatttgttccatgaataattaaaaacggtggtgcttcttttgtcacttttgaaaccggtgaattttcatatcctttttctggatttttcatgacattaaagcccagcaacagggattccggtgatgctgcacactgttctgcctcttggtattgaaacttcgaggtatcagttggaggataccatgggcaggcagcctgaaccttgcttgactgttccagataatctccaacatccagtgaaacatcttcatcaagtgccgccatacaagttaagtaaccacctgcggattctccagtcaccccaatatattctgcatcaattcgataccggtctgcatgcgctctcaaatagcgaattgccgcttttacatcctgaatctgcattggatactctccctcattggaggttcgatactctacacttgccactacaaatccgctctgtgcaagcttgctaagataggataaatgcgctgacttatccatgcgaagccatgccccgccacaaatccagactacacaaggatatgtttttccactaaaatcctccggataaatcaaatccagttttaaatctctgcggcagtgcccataccaggaatccacctgtgcatacgtgattcccgtaattgtcacatactgcggtttttccaccttaatttttaatacttctttcattcgttttcctccgatcacctttttcctttattttatcataccctttgtcaaaaaaaaagaatcctgggaggacaggattcttttttcgggtattctatgctttatcgttttcttatttttatttctgtctgtttagaaaattctcttttccgaaacaaacttctgagcagtaccatccacccccacgaaatagaaagtgccggaagtgcggagattatgattcctctgaccggagagatttctgaaaacacagttggtccaaaaaacctgataaacacaactgtcatcatgacaatcaatgtaattttctctttcatggtattcgggggtgtcaggaaaatttttttaaatccatctcaagtctttctggttcttttttcattttaaacaaggcgtacctttaaaatcggcagaaacgaaattttcgcttctgccggtttttgtttaatcttctttaatttttccgtcaattgtaatcgtcacaacctgccatggaatgaatttttcactgttttttaaggctgccaccgctgcccgttccaggcctccgcagcaaggaacttccatacgaagcaccgtcacacttttaatgttattttcagcaataatccgggtcagtttctcactatactctacggaatccagttttggacagccaatcaatgtaatttttcctttcataaattcctgatgaaaattcgcataagcataagccgtacaatctgccgcaattaaaagttttgctccatcaaaataaggcgcattgaccggcactaacttaatctggcatggccactgaccaagctgggactgctggacttctttgacagtttcttctttttttatactttcttctctgttgaattgatgcagggcatgtcctgggcatccggaaactgccggtttttctgatttttcttccttgtctttactttcctgcgcttttcttttcatattttcttttactgctgtttcgtcataagcggctgcttctctttctacaaatgtaattgctccggttggacaatttggcagacagtctccaaacccatcgcagtaatcatctctggtcagcttcgcctttccgtcaatcatctcaattgccccctcatgacaggctgatgcacatgccccacatccattacatttttcttcatttatctcaataattttacgaaccatagaaaaatacctccgtttgttttagctctgtcttgtttacaaacacatagtaaaacaaatggaggcaaaattatgttgttggtacaacaaatttaaaaatcttatttttaattctgcagcatttggatttccgtttcaaaaaaacgttcctgaaattccaccagtgctgcaatctgctctttgctgtatttgcctttttccttacagacaaccagcttgtcttccacgtcattttttcgtttaatcactgccacgacatatccctcataagcttccacagcttcaaattctccgacaacataagcatcgatttcctctccatctccagatacggtatctggaatgaaaccatagtttaagcaatatacaaatccgtgctctggatgtcttgaagcaaggggacggtcgattttcacctttataaactttccaaggtaagattccagtgaaagtgttgtgtttatatctctgttcttcatttacatttcttctttctattcttcagctcacatcggagttcccacttcaattagatttccatccaaatcatagaatcgaacaatctttttcccgaaatcattctccatcagcttgttgacatattctacttccggatacaactgctctagtttttctacaaacttttctatatcacgttcctcgaaatacaactcactggcatgatttttttgtttcacttcttttttcaaaaaatcctgccagatttttttctgctgtaatacaagtccttctgttaagattacggtctcgttgttatccagaacaacttccagaccaaaaaggtcgtgataaaagtgtttggatttatcaatatctgttacaataattaatacgttttttaatctcatggactctcctttccgcagccatagccaacataaagaactacttcgttttcatctttcaacaaagtttctgcaacctgaaacagcaacacaattaatattaatgcttctttcacgttaatcttattataacagatattgtcatttccgtgtaaaaaacagtctttggcaaacattcttttgagatttttatatgaatatgatagactactaactgtaatatatattggatttcttactaagaaatacttacaaaagaaaggcttttttattatttatgaaagaaaagatatttaacatcattcagattggagataaaagcaataaaatcagtcgtgcatttgatatttttattacgattatcattgtcggtaatattattgtcacttttttggaaacgtttgaccagttatcctctttttccggtttatttaaaatagtggagattgtcactgtttttgttttctgtgttgaatacatcctgcgcatctggactgcaaactatctttacccagaagtaactgccggacatgcacgttttaaattcttgatttcttttgatggaattgttgatttgctgaccatcattccggcttttttcttatccggttttgtcattttccgtatgctccgcgttgccagaatttttcatctgtttcgtctcaatgcaaagtatgattcatttaatgtcatcacaacggttctttatgaaaaacgaaaccagattatttcttcggtttttattgttttgattttaatgctcgcaagcagtctgtgtatgtacagtgtggaacatgaagcacaacctgccgtctttcgcaatgcctttagcggaatctggtggagcatgtcaactctgctcaccgtcggatacggtgatatttatccgattacaacccttggacgtatcatggcaatctgtatcgcctatcttggtgtcggagcagtcgctattccaaccggtatcatcagcgccggtttcgtagagcagtaccagagaaaaagcagtatttctgatttaaaagatgcggacattcaggaaattgcagaagtgtttgttgataaacgctatgccggaaaaactgtagaagaaatggaagaggcacagcaaatcaccatctttcttgttttacgtgatgatttttctgtgcttcctcaaaaaaatacggttttaaaattaaatgatattattattattcgggtggaaggggagtagtcagggatgaaactttcgtccctgattatttatccttgtttataagctcacaatcttacactcaaacggtgcaagcgtgatttctccctgtttcacttcatgcgcattatggttaatatacataaccactttctgtgtctcatttcctctggttacgatttccactccttcttcagaaggtgtcatcttgatttcacattctttcataatgtgttccatcaaaagattggtaatcttttcttccagaccgcatcctacatagtaagtcgttccattttcggtcttctttctggtaattgccgcaaattcttcatagaactggtcgccataatggaataacacttctgcatctttggtctgaatcatatctctgaaaattccgccttttccggaaattccttcaaattcaccagttccgattaccggaaatgcctcataatcctgaagactttcagtttcttctatagtaagaccggttaagtctccataatgaaccggcatcgtttcaccaaatggaatattattgtccacatcttttactgcatgacggtaagtaactaccactgttccgccattttttacaaattcatggatacgtttttccatctccggttttgtaataatcatctgtggcaaaatcactactttatagtcagaaaaatctctgtcttccggaatcacatccacaccgacattctgatcatggaatgatttatagaatttctgcatttctaccgaactgtctaacaaaatgctctgtctctggattctgaaagatgccagtgaatcatagtcatatacaattgcaacctgattgttaatcggggcttccattgcttctttataattggaaatatcccggaagaaactctgtacttcatagaattttctacgctttacattatctgcatcaatgactccataacagaactgttctgcaccttttgttgcacctcgatatctaaaatacattaaggaatctgcaccatgcgccatactctgataggaccacatttttgcctgattcggtctcggaagaaaacctgtgacatcatgaccctgagctcccataatggcttctgtaatccagaaattttccccttttaagcctctgatataatccagtccaaatgcaatttcatgaggttgaattggctctttctgacctccccacaccggataattattataggctacctggttcagactttttgctacttttgaataatccacatgttttcctaatcctccacctggaaaatcatgcatgacaactgcatccggtatgatttctcttacaagatttgcctgaaactccatgaaatccacaatcgactgactgcggaatctctcccagtcctgtctcaaagccggattatgcgttgtaatcgtctccatagggattggaatttctgagaaatcattgtattcctgtgaccagaaagtagttccataagtttcatttaaccggtcgatatttcctgcaaatttttcagaaagataactttggaattttttctgacagtttttacaataacatacatcactgccttcatgaccaatctcattatcaatctgccacgctacaatactcgtttcctctttataatgttctactagtttccgaacgattttctcagaatattcatacatccgtggactattgaaacaatacacatgtcttccaccaaaagttctcttttttccaccctcaaattcagaaacaatatccggatattttgctgcgagccatgctggaattgtagccgtcggtgttcccataataatttttaaatttcgttcttttgctttttctattacatggtcaaaaaaagaaaaatcatactgcccttctcttttctccatcaaatgccaggaaaattcagcaattcgaatcacattacagcccagctctacaattgtatccaaatcctgttccagcatatcagcatgccattgttccggataataatctactcctagccacataatttttcctccctaattttcatataatatcggattctttcctgcacttgcttttgtaagtgcgaaagtgcattttctaactatatggtagcaaataaatttttacctgtcaatgaatttttactaaatttatttatttttatagtaaattttttacttgccattattttcctgctttttgatgcttccacgaataaccagactacatggaatgacaattttccttggaagtttctctgcattccagaatctctcaagtgcaaatgtcgcttcttttgcactttcttttaaataaacctctatggaatcaagtggcggtgtactgctctcagaaaaggttgtattattataagttacgatattacaatccccaggaaccaggaagccatgttcacgaatagctttcaaaatacctgctgctgtagcatcactggaaataaaaagtgccttgggaggttttttatttttttctaaatagcgttccatcgcctcataagaacttccggaattcatctcacagtcaatcaccagattttcatcaaacagatttctgttaatcatcgaatttttataataataaaatcttggatccatcgtaagcattttcaccctgttatacgtataaactgcacctgcataggcaactctctcatatcccatctcatcaaaatgattgagcaccagacgtattgccatatgatagtttggaacaatactgtaatacttcatctcatccggcgaggaatcaataaatacaatattggatgtatacttttcaaaactgtgaatttcttctgttgtaaaacgtcctattgccactattccctctaaatttccatcactgtttttcacaaaattcccatcactgtttcgatataaacttactgtattccagccattagaaaagcactctgcttctaccatattttttaacatcatgtaataaatatcatcctgaagctgttgcatttcaaacatctgtgcaattcctaccgtaatgtttttgctgtttttaatcttttcctgatttcgaaccctagtatccttgtgcctttgagatactgagcgatatcccaactccactgcaattttcgtcactttctctcttgtttctgccgctacattcaaagtactgtcgccatttaaaattcttgataccgtcccctgagatacgccggcttttaatgcaatatcttttaatgttgccataagttccccttccacaatatttaaatttttactaaaaatctattaaaaacagtttatcacaagaactgctgtaatgcaaaaaaaccgactgaataagccggttcttttgcgtttttattctaactatttttctttctttttatccgtatttacttttttcaaaatttcttccagataagcgccatccagcttatatccttttgcatagattacaaatgcaagcactgtaatgatggtcggaatcactcccataagaactctcattcccatgatagtcgatgcagactgttctgcatttgcaacatatcctacaattgtaagacccacaccgatgaaccatgcagaaacagcagatgcggtcttaacaagtaatgtctggaaggaagcaataatactttcatttctgcttccaagtttcacttcaccataatcaatgacatcggctaacataacggttgtcgcacctaatgtcagacccgatcccattttgtaaagtacaccgcagactgcaataattactacattttgcggagcaaagaatccgctgataaccaatcctgcaagaccaattgccggactgaaacttgcgattgcaaatacctgttttttgctcaaatcttttgaaatcattgggaaaataaacagtgccgcaatttccgcaaattgagaagccgttgtgaagattggatacaagctgttgcttcctgctacatatttaaagtaataaattgcaataccacctgcaagctgaacaaccagattgtagcaaagtacaacaccgataaatacttttaactgatcatttccaaggataacatgaattgcatctttaattgttgttctttctgactttttatctgttgtttcataacaactgcggtcttttacaaaaacaactgtaataacagaagtcagtacaaagattacagcaattccaattgccagataaaaatatccttttgcatcatcgccttttcccagcatggaaaccagtttgattgcaaatgctcccattaacagccatgcaagactggcaaaaattctcggaattacagacatggaatctctctcttcttttgtacttgaaagagaaggaagcatagaccaatatgggatatcaataatggtataagacattccccaaaggatatatatcactgaaaaataagcatacatcgcagttcctgtcattccagccggtttgtggaacaagaaaataagaataatggagtttaccactgctccaattaaaatccatggtctgaatttaccccattttgttttagtgttatcaacaacaaatcccatcatcgggtcattaaatgcatcccagattctggccaccagaaacaggttaccgacaaacaaaggtgtcagtcctacagtatctgtgaaataaatcatcagaaaataagaaatgatggcatagcacaagtcttttccaagtgcaccgataccaaatgaaaatttactaaaatttgttaacttcatatgtgttctccctcgtaagttttattacttttatcattctccaatgtaaagaagcaggggaatgcttatctgcagtaaagcggacattcgcaatccgcttcgctacttgctcatgaacgcagtcgctttgcgatctgtcagtgggagctttcaactcccactgacagaagcattcccctcacccgccgcttagtgctctgcgcacttgaagcggtggaatgcttatctgcgttcaatttctttaaattggattaatgtacttgcataatctcctgtcagacaaaggtcaaaaccgtgctgcatcagatatgcaccactctttttaatttcttttgtttcaagaataacagaatataccgcctcttttttcaagcctcttaattttacagtcactttgcggtgtccgattttggtctgaggaaggaatgcgaaaaccagtccttctgcctcttttgtatattcataaagatgatagtcattttcagaagtattttgcagacggtagaaatctccttcctgaatgattggtctgattttcttataaagtgcaatcatttcttttgacagattgctatcttcctctgtaaatttcaaaatattacagccaattccgagtgttcccatcattgcactgtggaaacggaatttcatagaaatcacacgatttgaaataaaattcggacaatctgttacccaggcacgcattgccttgattggataaatataagaataactgtcctgaacagtcagacgatcataagcgtctgtgttatcactggtccagaaatcatcaaaaatcccaaggattccataatcaattcttccgccaccagaagcacacgcttcaaataatacatttggatgcttttcttttagttttttcacaatatcatagactgcttcgatatgtcggtaccagatatctttgtgaagattggtctgtgaaattggtctgtttgcatcccatttgatataatcaatttcatgataagaaagcaggtcatctaacatttgataaacaaaattctgcacttccacttttgtcatatccagtacatactgacctcttgaagtatcactttctcttgtatcaaagtgataaatccaatctggatgttcagcataaagttttgttggtggatttaccatttccggctctacccagataccaaataaaagtcctaaagattttacttcttttattaattcatctataccatttgggaatttttcttcattgacataccagtctcccagaccattttcaatgccatttcgttctccaaaccatccatcatccacaacaaaaagttctgctccaagttcctgtgctctttttgcaagcttcttttgttcctcacaggtaacaccaaattctgttgcttcccaggaattatataaaactggacgaagcccagctcttaagataaagtcttttgcaaagttatgaagattatgagacattgtttcaaatccactatttgaataaccacaaataattgcaggacttgtgaatgtttctcctgcctgaagcttaagacaaaagtcgtgcgcatttaagcccagctgcaccaacgtctcaccatacggtgtctgctctaccactccactgaaatttccggttctgcgaagcgcaccaaaatatacatctccacttgtctccgttgcatctttatctaaaataaaatatggattatgattgtgagaagagattcctcttcgattttcaattaaaatctttccatagcttaccttctgtacaaacctttgctgctcagcgccccaatgaccatgcacatttgtaaaatttaagtcttcatacggaatatgaaactgtccactctgtaactgctcgacctccattgcctcattggattcattatgaagcactacaaaacgctccatcaaatcatacttttcatacactttataatgtaattctattttcaaagcataatattgatccttcagttcaagaatcagctcatcatatgcttctgttttttcaatttgatatcccacatactcatatacaacttctctggttccatctgcaaatgttactttcagacaatgctctttataacgcagacttccgtaaaccggaaattcttctggagtaatctcatagaccgggtcatttgtagatacctctgtcaacaccggcatttcaaagtcctcaactgcttcaattcgctttccccagtataagtgtctcactaagccctggtcgtcaattccaaacgcataactattcgaaactgtttgtaacaagaaaacattttttgaattgttgatcacaatactcatttgctcttccccacttcttttcttttaaagtatcactatttttcatttcagtaataaatttaccacatttttttactttaagtcaaactctttttaccattgctttagtaaaaatttatctatttattttgtgaaatttgcacaataaatattattttttttaataacaaaaaagacccctttcggagtcttttctcttaacttttaaaatagaagctgaagtcccatcacaatgttccacatatatgcacatgtcttttaatccatcatattccctgtcaagttctgaagtatccatgctgcttcctatctgcttacgaatttcccgagcaaactttgaattcttcacaaatttgcggataattccctcaactgccgcattaatcctgtcctcattccactgtcttttataagtacagcggtgtccgttcacaagctttctatgtttgaaggcatatttgatctgtcttccagttttttcctagtgaattgacaaatgcatagattccataatctacacctccacgattttaagctatcccgaaacatgagactattcgatcactttttaacaaaaaatcccgaagttaagtcaagcggatattcgcaatccgctttcgctacttgctcataaccaaatagctgctacgcagcttatcagaaagggcttaccccctcctgatacaagcaagtccccaccattgcttattgctttttacaattaaagcaggggacttccttgatttggttaaattgccatcatccagtttttttccaactctgtatcttcattttcttgttcctgtaaaattcggtaaattgttctccaatagtgtttttttacttcctgacagattttttcgcaatctccctctttacaagctgctaaaattgcaagatgattttcatactggcgctccaaaatctctcctttatctttcaataattcatagcctgccaaaagattactgaaatataactctttccatgctttttcaagacgcggaagttttgacattatcactaactgctcgtgaaatcgattatcatattcaaatactttgtcaaatttttcaattggaatatgtttcatatgctccaaaatactttccatttttcgaatcgtatctttcggtatttttccatttagcaaacgtatactgacgatttcataatttgtacgcaacaaataagcttcataagaatccataagagaaaaccttctcacagaacaccccacgtttcttgtatactctacaagcccctcaatttccaactggcgtagtgcctcacgaatcggtcctcgactggtatgaaattcctgtgccagctccagctccacgatccgctctccgggacgaatctgacgcttcatgattttcgttcgaatagcatttactacgctttctcttaatgttttgtataataattcactcatatatctcctcttaccacaaagtgttctatgtgaattcgttaccactgtaaaatttatcacaaagtattttacatgaattttctttcactgtaaagttttatcacaaaaacatcacatttttttgatgatcttcttaacgatttctacggataaatccattccttctaccgttatgtgctcaaatggaccatggaatccatctccaccggtaccaagattcggacatggcaaacctcggaaactcagacgcgcaccatctgtacctcctcgaatcggagaaacatccggttctactcctgcttctttgcaagctgcttttgcatactcaattaactgcatacatggctcaatcttttctctcatgttacgataagattcttcgatttttacctctgcggttccttctccgtaaatagcattgatttgcgctactgcctgacgtagtttctcctgttttacatcaaataataccggatcaaaatcacgaataatatatttcatcacagcctgctctacagtcccgttaaattccatcagatgataaaatccttcatatccttccgtcttttccggacactccgcttttggaagcattccgtgaagttccattgcaatggtctgcgcattcttcataatatcttttgcgcttcccggatgaacattcactccatgcacaatgacttccgcaccggctgcattaaagttttcaaactgaatctctccttcatggctaccatctaaagtataaccgtaaactgcgccaaattcggaaagtttcaggtaatctgctccgcctccgacttcttcatccggtgtaaacgcaatacagagttttccatgaggagttttttcttgcatcagttcttccactacggtaagaatctctgcaattccggccttatcatctgcgccaagcaatgaagtaccatctgttgtgattaacgttcttcctttataactgcttaatcttggaaaatcttttaccgtaagcacttttccagaagtaccaagttcgacatctttcccatcataattttcaatcagctgtggctttacatcacgtccattataatccggagctgtatccaagtgtgcgattaagccaagtgccggaactgcctccataccctcggtagcaggaagatagccatacacatatccatattcatccatttttacgtctgaaagtcccagtgctttcatctcttctacaagaagcgctccaagatccagttgtctttttgttgtcggaacactcttgctgttttcatcacttgcagtccaaactgcaatatattttaaaaaacgttcataagctttcatcttattttttcctcttcattttcaattcttattagaaaaatacagcccggagttcaatgtccgggctgtttcattatcataacaaatttttattactgatgggtatatccaaagaagaagtatcccagtggacagcaatataaacctttgatgccatctgccagcatgtatttctgagtatagaagtaaattggagctaatacactatcttcaccaaccagtttatcttctgcctgatgtaacagttccatacgtttgctggtatctgtttctgcttttgcttgtgcaatcaggctatcatagtcactgttagaatactgacaatcgttatttcctccgccagtcagccacatatccaggaaggacattggatcattgtagtcagcgatccagctgttacgtgcgatagaataatctccgtctttacgtgtctgcaggaatgcagcccattcctggttgtttaatgttacggttacaccaagttcattttcccacatagactgcagtgcttctgctactgctttgtgagcatcacttgtgttgtacagatattctacaaccgggaagccctcaccgttttcatatcctgcttcagcaagcagttttcttgcttcttcacagttcgcttcatagtctgcatctgtaggtttataataatctccaccaactgtacggaagtcatctccgtcagtgccttctgcgtcatagataccagccggaacgaatccacctgcttctacctgtccggactgtgttacctggtttacaatataagtacggtcaattgccagagagaatgctttacgaactttcggatcgttaaatggctctttctctgtctggaaacatacataataagttccgatatagtctacgatcttcatatcgccggaagcgatcaaacttgtaatttctgcctgaggcgcatcctggatgaaatctaattcgccggatttaaatccggataacattgcgttctggttgtccattaatttgaaagtaatggtttccggtcccagattttcaaaatcatagtagttttcgttcttttctactacgatctgagagttgtgtgtccactctttcattttgtaagcaccgttagatatataagtatcaacgttgaatgtccactgatctccgcctttttcgatcatgtcctgacgtaccggcatcatagcagggaacgcacataattcttcaaagtaaggtaaatcatttactaaagttacttcaaatgttttgtcatctactgctttaacagccagttcatctgctgatttgttaccatcgataatatcctgtgcatttacaacacagtctaacatataactgtagtctgctgcggtttctgggtttaccagacgtttccatgcatattcaaaatcatttgctgttacatcctgtccatcggaccatttgattccatcacgaagtttaaatgtataggttacagttccgtcatcatttgctactttttcatagctttctgcctgtccaggaaccagtgcagcactgtttgcagtaccatcagaaccatttgtttcttttccactgtcttcccatttcatcagaccttcaaataagtgatgagccattgttccggcatctaaagaagtacttaatgtcggatccattgtctgtggctcagaagccaggtttactgtgatgttaaactctccatcacttgcggtgtcctttttccctgcgtcgtctgccgcatcttctttcttagctgcaccgtcatccgttgctgtactgcttccgcagcctgcaagcatagatactgtaaatgttgcagctaacaggatagataaaacttttttcttcatatcctctctccttttcttcttttattgataaacaggaactcctgcattatccatgtaagaacagctcgtttccccgtgttacttactgttccaaaaggtggcatgccacccagtgttctttttcatactctttaaatctcggcacctcttgcttacatctctctgtagcatatgggcagcgagtatggaaacgacagccacttggaggattcattggagatggaatatcaccttctaatacaattcgctgtcgatttttgctcacctgcggatccggaaccggaactgctgaaagcaaagttttcgtatatggatgtaacggattacggttcaactcataactttctgcaagctctaccattgttccaagatacataacaccaatacgatgtgaaatatgtcttacaaccgataagtcatgcgcaatgaacaaataggtcaatcccaattcctgctgcatatcttccagcatattaacaacctgagactgaatggatacgtccaatgcggaaatcggttcatcacatacaataaattccggatttacagccagcgcacgggcaatacctacacgctgctgctgtccaccggagaactcatgtggataacgattcgcatgctcagtgtttaagcctacatggctaagtaactctttgattctatcggttcgatctttttgattcggacatagcttgtgaatgtccaatgcttcaccgataatttctccaactgtcatacgtggatccaagctggcagatggatcctggaaaatgatctgcatcttccgacgatatggaagcatatttacctgttttgcttttggaactttcaccggatgaagaattccattttcatctcttttccaaggatcttgtccttcaaaaatcgtctctccatcatatacaatttttccggaagtcggattatataactgtaatacggtacgaccaaatgttgtttttccacaaccggattcgcctaccagaccaagtgtctctcctctttttacttcaatggagatatcttctacagcctgcactccaggtcctttaacacctttgattgggaaatattttttcaggtgctcaacctgaacaagagtatcttttttctcactcatggttgtctgcctccattttttcattattattttttgctgcttctttttgtgctttaatctgctcctgtacgcacagccaacatgctgatctgtgattttctcctaattctacatatggcggcattttctgtaagcaaattttcatcgcactttcacaacgaggtgcaaacggacatccttccggcgggtttaacatatcgattggtgttccctcaattggaatcaatcgctcatagctatccgcatcgacacgaggcatagagcgaagcagtcctctggtataaggatgacccggcgcatagaaaatatcatctaccggtccctgctctacaatcttacctgcatacataacagatactttgtcacagatttctgctacaacaccaaggttatgggtaataaaaataatacccattcggtttgttttctgaagttttttcattaactccagaatctgcgcctgaattgtcacatcaagcgctgtagtcggttcatccgcaatcagaagctttggatgacaaatcaaccccattgcgatcataacacgctgacgcataccaccggaaagttcatgcggatactgcttcatacgtttttctacattgttgataccaacttcttccagcatttccatcgcacgtttctgtgcttcttctttgctgatatttttatcatgcgcttttaaagcctccatcagctgatttccaatcgtatagaccggattcaagcaggtcattggattctggaaaatcattgctacttcgcttccacggaaatttaccatttctgccggagtttttgccaatacgtcctgaccttcaaatgtaatagagccaccgattacttttcccggattttgtaacaatccaatgatagaatatgcttccacactctttccggatccggattcccctaccacacccattacttcattataatctaaatcataactgattccatttactgcttttacctctcctgccggagtgaagaaagaaacctggagatctctgacttctaacagcttgtcagttttattattctgttccattacgtctctccctttcttattttttcagtttcggatctaatgcatcacgcagaccgtcaccaaacaggttcaaagacaggatcataacacttaagatcactgccggaatgagcagtcggtacggataggtgcttaatccgcttaatgcttcggaacacatggaacccagactggtaagcggagcagatacaccaacacccaggaaagataagaaagattccaggaaaattgcggatggaatctgcaagaaggttgttgtaacaatctgtccgatacagttcggaagcagatgtttactgatgatacgtccaccttttgcgcccagcgctcttgctgcagttacatattcctgctgttttaactgtaaaatctgaccacggataatacggctcatggttacccaatataacagaccaaatgcaataaacatagaaatcaggttcggtccaagtaaagttaccagacgctgtaaaacaccatcaccagaattctggaactgttccagagccggttttaaagttgcagagagcaacaagataatcagcatctccggaatagagtaaataatttctacaattcgctgcataacactatcgactacaccaccgcagtaaccggaaatggatccgtaaattgcaccaatgatcaatactaagattgctgcacaaatacctacgataatggatactctggcaccaaccataacacgcaccataatatcacgaccctgatcatcggtaccaaacacatgagggaatactttctctccggctgctttcttttctaattctgcattcgaatatccaaacatactatgtttgattttcagtgcttttgctgcatcttcttctgtcacttcttcactttcagcttcctgctgagatacatttgcttttgcacgaatttttgcttcatccacacgagataaggtttcacctttggcttctgcctctttacgtgctttttctactgcttcatccggtgtcaggtttcctgcaccgttatgttcttccatataagcattgattttttctgttctttcaggctgtaatgccaaggatgcaacgcttcagaaccacgaatctgctgtttataagtatatggtacaatagatggtcctacaaacgcaaaaagcgccagcaggataataattaccaatgcaaccattgcaacggtatttttacgaagacgtctccatgcatctttccaataagacacacttttgcgttcctgaataaaattctctttctcttcagaggttgccggttcaaacgcatctgccggcaaatcattccactggaggatatcctcaatattcggctgaagagaacctggtttatgatatcttttcttttcagacattaccttaatttcctccctttgccagattgatacgcggatcgaccagtttataacatatgtctacgagcaagttcatgatgataataaatgctgccaggaaaatagttgttcccataattaacggatagtcacgattctgaattgcctgtacaaaatatcttcccagtcccggaatagagaatacggtctctacaaccaaaccgccgcaaagtgtaaatgcgatctgtggtcccaaataagtaataaccggaattaatgcattacgtaatgcatgtttgaaaataattttactattcttcaaaccttttgctcttgctgttttaatatactcctgattgattgcatccagcatagatgttctggtctgtctggacaaatagcacatcggataaaaaccaagggctacacacggcaacacataactttgcggagtaccatcaaacaacgccgggaaaactttgattccctcaacaccaccacagaatgtatgtaataataaagttgcaactacaaaccccggcatggaaataccgatagtacacagcactcgcagaaaactgtcaatccaggttcctctcttaaatgctgcaagacatcccagcggaatgcctaaaagcactgcccataaaagagcaaggctacctacttttgcagataccgggaacatttctttgataattcccagaaccggacggttcttctgcatcttgatggaagttccaaaatctccctgtgccaagtttttcagatacttgcccagctgaacatacataggctgatccagtccgtattttgcattcaatgcctggattgtcgcctcagacggtgttttttctgataaccatggattacccggaatcgcattcatcaaaaagaacgtaatacaagcaacaagcagcaatgtaacaaatgccatacagattcttcgtattgtgtattttgtcatcttctatacctttcctctctttctcatctctcctgtcgatgtaaagcggacattcgcaatccgctttgctacttgctcatgaacgcagataagcattcccccacttcaagtgcgcagagcactaagcggcgggtaagggggatgcttatctgcgttcaaattgtaaattgtcgacaatatgacaatattatacccattttaacgcattaatgtcaagataaaacaactatttttatattttctctcccacacaattgtgcgtatattatggacatttacgttttataatctcatacggctcgctataccagatttttggctcatctgcttcatttttttctaaaactttcctcattaagccatctattttttccacctgatcttctacattattatccactgtcccatagatttcgccacttaaatccacccctgcatctctcgaatataaaatgcgatatgataagacaatctctcttccggcgtctttaattcatttcccaaaatttttttaatatttccaatccgatataatacggtattacgatgtgtatacatttcagaggctaccgcctgaatgctcccattgtgttttagatacgcgtgcaatgtttccacataatttgcatggtatctgcggtcatgttcttctaatgctgccagacattccgcttccaattcttttaatatccctttgtcctctaccatatacagtaatcgaaataaaccacattcatcaaattttattactcgttttttttgcacgatcgccatatgcgctgctacctttgccctatgatagcttaccgaaagtttggaaatatccatacacctgcttccgactcccacgcacagtttgagctccggcatacgcctctctcctctttttatagctccttctattaattggtacaaaaattcttccggaaccgcatttgctactaatacaaaatctgaattgtaataaaagaaactggcattatgtgtaatatcttccagatacacttgtattcgataagacaacttctttctctctacggtatccatagcatccaacccttcgcaagtcaataaaaacacctgaaagcttccatctacatcaaaatgttgtaataattcttttcgatattcattctgcttctccggagtctctattaccttaattaaagcggaagcaatctgctcatcggtgttatcctgcaaaaatacatgaatactaaagtcttttatcatatcggataagtggacttcccaaggtaccgtcaataatggaagatcattttcgtcacagtatgcaatcaattcttttggcacttcttcaatatactgccccacattaataatcaaaccagaggcatgaaactggttcagctgccttgccaaatgcatccagtcttctttttggggaaatcccaacccggttgtcactgcaagctcctttccccaaaaattttgtataatcgttgttccctccagaagatgtacccaactgatggaattcgcccagccattttttccagccaaaaatttcatttcatatcgcttttctgcgatcaatatcatatcttctattgtaaaactcatatacgctgttacatcccttcgtcttttttatatttttttattgtaacatagtttttgtgctgtcagcacagatttccactccaatttttagagttatccgccatagcttttctccatgtttgtgctaaaatatagataaattaaaaaatgtttaaaggaggcataattatgagatttgaagtttatacaaattcccaggatacaattcttccggaatggattcagaccgagcgttatatgtattgtgacaattttgtaaacgactatatgaaatctaatcgttttagtcttctttcttttgtcagacatctgtttcacagataatcatatacctctctttttgaaaaaaaggacatccgattcgggtgtcctttcttcttttggatgctttttttctacatccgacagttttctatttatctaaaactgcaacctgaattgcctttactgcctcctccatgtatttgacatcttcctcacatagcttaatatccagacattttacggtatcttctacactggaagcttttcgcattccaaccagaagactcattctgtcatactgagacagtgcccaggattctactaatgccgcaaaactgcaattgtatttttcacaaagcaatctccaagtttcaaaagctctgcgcaacccctccttcttctccggagctgtccaaggtattctggatcggatgtcagtttttgcaaattcacgttccataaagaccggagaagttaagaatccttcctccagtacaccataagtttgaaataccgtattatactttttacacagttcaaaatattctctgccatggaaaggagagagaatactgaaaaattcttgcacaacagatactcttccaccagcttcctgatatgcagccaaatccgccggctgactgttagaaagtccataggtgcggatttttccttcacgaaccaggtcttccaaagctccaaccgtctcctctacaggaaaactgctgcaaacataatgtacaataatagagtccagataatccgtttccattcttcgcagcgaatcctcaacatcttttttcacagctgctgctcgggtgtcattatttacggtataaccgtctcgttcgtaatggaaattaccaccctcatctctccaattcaatgagcatttggtctgcaaaataaaatcttctcttcttcccttaagcgccttaccaagcagttcctcacttacgcctgtgccatacaccggtgcggtatcgatgtaattcacgccatattcatggcaaacgtcaagcagacgcttcgcatcctcaactgtagaatctttatctgtccaaacacttccgcccccaagtccccaagtacctaatgcaaccacagaaacatcgatatccgtgttgccaagcttttgaaatttcattgtaattcctccgtttttgttgttttctatgctattgagtaaaaactattaagtctatccaaaagttattttctatattttttgtagacaacagaccgtttcgactgtgttttcgttgagcaaccgaattgcttcgccttcaaaaccttcatattatttcttcaatcgtcatctcatatacttctgttacttttttcattgcttctgatatccccggctgctctccggtcctatctctcaaaagttctgttaactcgttactaacctcatacagacggtcaaaagaaagattctggcaaacccctttcagtgtgtgtgcaccgcagaaagcatcttcaaaatttttattttccaatgcctgttttaactgtagataactctggtcttcaaggaactttaatgtaaatctctgaatcagtgcttcgctgtgaaggcgccccaggacagcttcatagtttcctccaatagcttcatagcactctcgcattgtcatattttagtcctcctgtcaattgtattccactaattcatgaacctctgctagtcaattatatacataccttaaaatcgtttttataacttcatcaatcacaatcggctttgacaaatgtgcgttcattcctgcatccagtgatgcctgaacatcttctgcaaatgaattagctgtcattgctataataggaatgttttttccatccggtctgtcattcatcgccctgattgcttttgccgcttcataacccttcatttcaggcatcatgatatccatcaggattacatcaaatgtgccttccggatgaaatccgcaaactctttatctcgtgagcttccgttcaaaagtgctacacgcataccattgtaagtactgtaatcgccatccacaatcgtgctgttgtcactgcggacggtcagcatcccataattggttccgatcggacgtgaaaaatcaaacttttcttctctgtccggtgttttgcgggcagatgttaccatatcaatctcgccatcttcaagcatctgctgcatatcatcccagctctgatcgtatccgacatattcgtaatctacatcccaataacgggccatcaaccgaaggaaatcatagccataaccgctgcggttcccctcttcatccatcatgtgataaccatccatggcaaagaaaccgactttgacagtttcatgctgcgaactgtcctcggctgcatatgcagtctggggagaaaatatcatacacacgcatacaaaaaccagtaacactgccacatatttctttgctctcgaaatcatattaaatctcctgtctgtcaaatatatttctctatacgtctccttgtcaacctcctgttttaataaattttcacctgtccctactgcttctcaattcttcgcatatagtctgcttgattgttttatcatctaatggctttgcaagatgtgcgttcattcctgcttccatacacctttcggcatcttccctgaatgcatttgcagtcatagcaatgatagggattgtttttgcatcttgccgttccaggtctcttattgttcttgcagcagtaagaccatccatcaccggcatcataacatccattaaaataacatcgtatgttcccggttcggaagcttcaaagtgctgaacagcttctaaaccatttttcactgtttctactttagccccattttccgtcagcataaattctgctatttccacattcagctcattatcttcaaccagcaatacccggatatctgatatatctgcatcaaaatcttctttttcttctggccgtacattcgtatcaattttaaatggaagtattacagtaaaacagcttccttcaccaagcttgctttcaactgttatggttccgcccatcttttctacaagttgtttcacaataggcattcccagacctgtcccattataatcagaacgtggggaattatctgcctgtacaaatggagtaaacaattcattttttataaattcttctgacattccaattccagtatcttttattttaaattcacatgtcatatgatcttctgatctttcaatcgttctcatactcatgtaaataaaaccattcaccttattgtacttcatactgtttgtaaacagattcatcaatatttttttcagatgaactgcattgctccaaacatatataccactgtaatcatcatgttctcctataacatgaagtcctttttcttctgcctgaaaagatagtgactccgtgatttcctgacatacctgatccagattgatggattcatcactaaaaaccacggtatcagattctaactttgccatatccaaaacatcatttaccaatgataatagcagtttcgaagactcatttattttattcaggcaatcttttgcccgctcaccatcatttccgcttttttcaagaattgtaagcatgcccataatgccattgatcggtgtcctgatgtcatgagacatgttatttaaaaaggaagtcttagccttattggcactctgcgcttctgcaagtgcactttgtaattcctgctgtttttcttcaagctcctgattcagcttcaatgcctgctcagcagacttcttggatttttcttccgcacgttttgattttttcaaagaatcaagaattatacacagaacaacgaaaaaagaaattccagcgataagtgaaactgtcagtaaattgtcctgaataaaatccttcgctgtaacttttcgtgaagaagcattatacgaaactactgcacctgaaaattgagctgtaggcatagatgtcagtgttttattcagaatggacaaaagaaccggttctccctgctgaacagcaaatgaaacatcagcttcttttgtcagaaaaacactatgaagcttattatttttcaaatagtctgaaacagtacctgaattgcttacaatacaatccgtctcccctttctgcattgcttttactgctgcatctgatgtctcatattccacaacctcccattgcggataattgtatgaaagatatgccttcaatgcaaaattatctttttcaacggcaactatattctctttattttcatcaaaagaatcctttgccgtaattgctgccatattgagagtcaatagcgtatccgacaaagcaaatccatttgtttctgcaaagtatggattctggtttgcatgaaaaatcaggtctatttttccatcctgcaatgcctgaagcagttcacttcttgtatcatatccatttaattcaaattccagagtctgaccttgcagacaattttctgcaagatccacataatctgtgataacacctgtcaatttacctgttaatggatctacactgctgatacctccatcctgattcagatacccaatcctgagtgcaccatgttgcccgatccactccctttcttcttttgaaagaaaggagctgctctgtgcagaaagataacgcctgtagagatcatctgtgtaaaatgggttgtcatccttgattctgcgcatagcactatccagtgcttctttgatatccggacgttctggatttataacgaaatagatttctgtctctccaatacttgtaatcggtgaaatatccgattcttcccaacgggattcttctaccgaaacaaagcagtcaatttcgtgtttcgacagtttgtccataacttctgcggtattagaaacattgatatgcttcgtatgcagaccatattttgattcccattcattaagcacatcctccactatattatctttagagacaccaatattttttccctcaaaagaatccaaatttcctgctgtaagatccatattggatgcatccgtatagatgtaatatttctcttcccccataggcatatcggaaaaaagcatattttcagcacgttcgtctgtataggaaatgccaccaagaatatcaatctctccatttttcaactgtgtaaagcagtttttccaatcacttgttatgtatttatatgtccatcctgcataacctgcaatatcttgaagatactcataaccatatcctcttctttcccccttttcattgacggtattataagtttcttcaaaagatcctacccggataacattgtcagagttttctttggcaaatgtaggaacggataaaacaataaaacatataattgtgcaaaatataatgtaacaaaatttgaaattcattatattctgtactaatttgcacttcttcatctttctcccctcctctaggctacagttgcttgcttccagattttaattttacattcattaattatcaataacctccccgctatttttcacaatatttttccaaacagcttctgtattacttattcaagtgctctaccagaacaaagcggacaagtccgcttcaaactccctcaatccctcaatccctcaatccctcaatctttgagggacttgttacgctttgcgtcccagactttcatctggtttgccgatttccatattatagctttaatacttatgcaaaaaaactggttttattatactatagcactctactgtacacaagaaaaaacattaccgttttaacgcctgaaaacaaaaaaagaacagccgatacatatactcgaactgttcttctacttccgaagtccacgcagcattgacattactgtttcctgcttcttaggttgacggctagatacgcattagagatgtctccattgtaatgctatttcttctaatggtaaccatactaactgttctccgtcatcagttttactcttacacaattttaaatcttcatccaaaattttcataatcttgttgcaccaaaatcatttcaatatcgtttttttattaaattaaaaagtctatctgcagtatccggtcctgttttgccagtttgctttgattgattgactcctacaaatgaattcttcgaaagccttgttgcaaacacgagataatccttaaacaactcgacagcttcattctgaataacatttgcagcgataataacgtcaatgcctggattatgattctttaactcatcaataatcctcattattgattttccagtattaatcacactatcaacaataactactctctctgtattaatcacaggagcatcatcttgcttcgggttcatcgaataaaaaatgccgcctgctcccatatatactccgtcaccaaaaaacctgccacctcgttccaaaactaagattgatgtatttttctctgggaatacggtagcaatgcgccttcctattttttctcctaaacgcacatgtgctgctgccagcctacttccacttattcctgaattcgatttgcagatagcaatatcagcttgtacttcttcgtcctcatcagccaatatcaccaaagaatgatcgtaaatcggcaccaagcctgataagctttcattcttcaatgatctgcttattcgcttaccaatatacagaaatcctttatcagcctcgcgtaacatatataaatcaatcttgctatctccataggcaaaaatagtgtatccatgttctcgcaattgctttacgacataatacttaacatctgcacttatgtatggactagcaaatatagttccaagattcttagcattagcaatatcgctccacaaatcttttattccagaagaaagcacaacataattattcgatgcaactatgtcatacacttcattattaattgttatctctgcaattttagatttgtcaatagacgcggtttgtaattccttttcaaaaagaaatgattgatagccagtataaaaatctccatcgaagatctttgtcttgccattacaacagaacctatatgaatcttgaataataatggttttatctccgtcaaccatatacaagatatcctgcttgttgaactgctccattatttgattacagatatctgtcgctaaatcataggagctgaaaccttctcgaagtaaagataagaaatcaaaaaacttattctgttcttcttcattatcacttacaacgtaaaagtccttatttcgcctatgacattcctctctaagattatttatttcaaactcctgccattgtcttaacgactcaatggactcgccagcaaacttagcatttttctctgacaaagcatatctttccttaagattttccggagaacaatacagataaataaagatgtcgtacaaatctccgtcagcctcagtaaatgcaacagtttccataaatgaatagtgtccatctgaaacaattacttcatcattcaaaccattaatatattctgtgtatttaattctaacttgatgtttctcttcttctgatagttccaaaaaggaaccaccgcaaatacgtctcaactcctggctgccattaataacctttgcatcagttattctatccatcaatgtacttttgcctgcacaaggcattccatataatgctattttcaaccagtaaacacctccttgaaacaacagtttctgtcaaagtcgataacgtcaaaactgacctcatttagaggtgtgtcgtaaggcattgaaaaaggtaaatcaatacaattaccacatatgaatatctttccatttgcgtaaaaaatattatccattcctgcaccacacataccaccatacatggtacagtcgtagccaccagttctaacattcaatcgttccatcgccttattcaagaacgcattaaaatcaggtagcgatatcccctgttttccaatcatcctagaaaacgtaatcctattaccaaattgttcaaagaactctatggtcgcttccggattatcaattatctcttttccaacagtacaattcatagaaggatacttcccattcacttctttatataaagctatattttccatcactcgctcatgagttccacatctatacttgtcgtgaatagcagagattccatctactgaaaagccaacatttacattgtattctttgaagaattctaacttctcacaatcaactaaaagaccgtttgtaatggtgtacgcagcaattcttccagatttcaaataatcgccaatatgagcgatatactgcttaagtttttcataatctaacattggttctccattacccacgaaccctaacttaaacaaatcaatatcgttgtcttcaatatgcgaagtaataatatcaagaatagtaattacatccatattgtcctcttgaatgtaattcttcttctcctgaaaatggcaataagtacaattgagattgcatcgattatttatcgatatacaagctcgtgttaccatcttctattcccccttttctgactattcttattgttacctctattaaacttctttcttgtaggaccagattcatgatactcactaacccaatcagcagcagttttaccatcaatgtcaacgatcttctgatcagctcctgcatcaatgagtatctttcgaatatcccaagtatgcttttccttattattttcaaagtgaccattcatgcaggccttcatgagcgcagtaaatccattagcgtcctgttggttaatactggttctttcatcctcacataaagcaattacaaaatccttctttccctcccaggcagcaatcattaatggcatattgccctcattcttctggcgtacttttccggcatcaaaaggatttctacttccaacattaggatttgccttacactctaaaagcaaaaacataaacatctcatactccttcatctgcactgcatgcgatagagcagggaaatatctacgactgcaatcacgcttattcacatctgcaccaagctgaatgagccatttgattttttcttttctttgctcaattgtggccctattatttcttacagcagaaataataagggtatttccatcctgaagatatgcattaacttcgtctgctgtcggttcttcgcattcctcatatgaatctgcgtaataagcgtcaattctagccaatttagtcatattgataagatcctgcttagtagccatatattctctaagatgtaatgctgaaacggattcatgccctttaagatatgctgaataatcggtgtcctctgttatgatatctactttgcagtgatatgtatcagaagcctcctgtgcaatatatattattttgcaatcttcgttatcttcatcagcatcgccattatattccataagaattgtacgagaaccatagctaataccacgaataacttcccaagcctttctcccaagagaacctgagttcttattctttatattatctaattcatcaacaactacctttggaataactaccttgctatattccttgttcagttcatcaattaactgtgaattcttaagtaacgctgaagtatctggaactgcaaccttctcccctcttaaaaattgttcggtctgtgattctgacatttcaaaaaccttacaatattttcttgccatttccaatagagttttttctgcagtttttccaccttcaacacgtgaaatagacgacttgttcataccagttcctggttccaagccctctaatacatcaatcttctttgccatgccatccatggtacagccattcttttcacgaagctccttcaatctcgaacaaaggaaagctatctgattatcatttgccataagtaacgcccctttcataggtatgtatgtaatttgattatttgctttatctcatactctcattatatacctcgttatatttttcacaacgaaaaggtgtgtttttgcaacaaatattcaaaaggcgcaacttatcacttcatttacttaatatatgcaactaaatgaagctacttgcagcaacacaaatagatcagttgcattaaccagctattcaaatttctaaatgcatcactacttcttataatatcgttgtctattctccgaattatccgctctgtcatttccatctgtgtcacacttcggtccaacttgagccgaagtcatatgatttgcttcattacctgccagcacttctgctccattatctgacagtgaatcatccgataaccgctttccctgatgtttcatggcatccagcttcatcttatacgcaaatgctttctcacttggcttcagattctctctatgcaggttagagtcaaccattgccacaactgactgagcatcatccaattctcttatcacaaccggaatcttcgtctctcctgcccatatagcagcttccattcgcctgtgaccggatattatctcatatccatccccataaggattcgtccttaccagaagtagcacaatcactccttctttctcaatactcttcatcagctcgcataattccgtatttacttccaccttaaatggatgattcttaaaatcatgcaactggtttatttccacattccgtatcgtctccataaaatcgcctttctcgaatacatcgaattcatctattctgaaatccatctgatacgatgactttcagatacaaagaaagaccgctcactttcaatttttcttgaaaatgaacggtctttcacgcttctgttatttagttgaatgataaatgtattactttctctttgatgtgtttctgaagccgcaatccaataccacagacacgtttactccatcagaaatagcctttttatacgtttttcggtcactctggtcaaacctgaaaaacctctcaaagtgcctaaaatcaaggattcttacaaatcggtccgatgtagtgcaactattgtctctatatgcgtctgcgtttctgcagatacttctgttacgattgtttcctgctctgttgctgctgtactttctgtctgtgccggtgacggtgactcagaaaaagtctggtctgctgcaggtgctccggagcatgctgccatagacattgccattacaacagcaagcatacccttcatcatactcttaattctcataatcgtttctcctctctgaaacatgttttgtttttcctctgcttcactatacaataccgttgtaaaaaccaatgtccaaagtaggaaaaatttgagtaaattccgacacttattttatgcagttctatctttatgagatttcatcaacatcataatacttaaaatcccggaagcaggcacttcctcctgtttcctctgccgcataacagaacagaccaaaccggcaaccagtaaaatgatccagtttgaagtacagcttatgcacggttccgatgggtagccagtctcccttatttacccggtaatagcagcgtgcttcatccttcatgttacagaaatctgcttcaagacgaaaatctatctggtgtgattcaacaacagttccttccgtcatatccaatataccatcttcttttttatccagcataaggacttcatattttccatgatgttttgtaatgccaactgcagcataacagctctgcaacgcacacaaacctgcgatatcgccctctttcaatgcagaagcatcaacagtaacctcagctgcgcaggacggataactcatcctttgcgtaagcgtatttactgcctgtgtaagctctgtacaaacttcccgtgttgtaattgtataggttccctgcaatgcatccagatgatagtaccgtggatctggatcatgattaaactgccagcgcggaagcaacccattacagaaatcatcacttcccactaatggctgataaatatatcctggtctggtactgtgaacctctatttcttccggcacatgtccgttctgtccaaaaaacggaaaatgatccttccaggtaaccggaagcagaataggaatccgtccaactgctccggaatcctgaaacagcattgcataccactttccatccggcgtatccactattcctccctgtgccacgccctgtccacaatatccacgatcatcacaaagtacatctccacccgtgaattctccttccagagaatcactgtaaaagcatgcttccgtccgcatccagcggtctctcagggaatgaaccagaaaaatataataatagccgtttattttttgaatatgagaaccctcatagcctagctccgggttcttatgatcactgactaaaagacgatgtaatccgtccttctttggtgcagtcaaatcttcattcaattctgtaatccagatttcatcatttccatatacaatatagtttctgccatcctcatcaaataataaagagccgtcatgataaaagccttctatcagctgctttttccatggaccatctattttttccgaagtatacaaataagtcttacgggtatcatttgccacaaagcagatataaaatcggccttcatgatagcgcagggaagctgcccacatgccctgtccgtaaatattctgaccgcttttcagttgctgcgcatccgtatgatccaacgtctcatagacataagtcacatgctcccagtgcaccagatcaaaagactgcagaatctcacagcccggcataaagtgcatggttgtggataccatataataggtgtcttctacgcggatcacgtccggatctggataatccaatcttgttataggatttacattcattgtttattcctttctgttttatctccatattctttgttctattctatttttactattttatctttgtttcttatccgtctgccttttcatctcttctctgccccatttcactattgctaatatcacaatctcacagtaaaatataatcctgtctttgacagttcaataggcaaaaaatcgctataggactttaaacttaaggcttgtagcgattttggttttcgttttacaatgtagtaatttatctccttttactaattttttgaatttctttcatctttcgtttggtaatgaattgataatccgtgttaaaaccacttatatcatgaagcgtatctgtaagttttgatcgtctgtaaaggggctggaactaccccaaccgactaacgtgagggcactgaaaaactgtttttacatacaatatatagtagtgtaaaacatataagtatgctttaccttgtaccgttttgtgtaaaataaggactttttcagtagcgtcgactcgtcggatggggttttctgctctataatagataaacgagagcagacagaatggcatttatatcgaatttgaaatcatatttatcccgaatcttacggcaggtcttgtctagctgcaagccatagtaaatgtattgtagaaagagataaccaccacaataaaatttttgctggttgaaatcaagtcttcggtcggcatgaaatgttatctgcacagatttctcagcctgttcctttttatatttttccgtttcgagtcgggcttcttcacgtgcccaagccataacatcatcgcgtgttggcccatgttcttttaataattcattaaacacgcctaattttctgacagtggcagaagtgctttttcctttgctgtttttaaaacttttggtgatataaaaggattctgaatttttctatttgttcgttgtaactctcataatttctccatcttttttagtatagcatactattaagagaattaccactaattactactaaataaaacagaaaatttgacataaaaaatgcaggtagatcaatacctgcgaccactttttctaatattcaactgtcaaactcccaaatacgaagcatccgtaaacccgaatgtttcagctattaccattcatcccgatttgttttctcggctgggcatcttgaaaaatgccatatagtgcttgcatatttcacttgtatagatagcaattggggtatgtgtttgcggacacatacttggaggagtctgtaaattttttatcattcatgccttctaatttttctaatacctgcccggcaatatcttccatatcgctgtcctttatgtacggcattatccgtctgatttcttccatcatcttcattctgttctgtgtctcaaaaacacacatgaaattgatttcttctactgtgaatttattcatcatcctatatccccctatatgaattttttggtttttccagttccttcgtatccttattgtttccctgtgttgcttccttctgcttggctgccagtcgctcctttaaagaagaacgtgcttctgacttttcctgctgttctttcttttcttcctcacgattgaattttcccacgccattgttgagcctctcatcaatcatgttataattctgctcctccagttcctcaatcttagcaagcgacttgtattctgccaatttcacaagcagttcctttgcctgtctctcactgtcctcgtctattccttcgtcaatagataattttaatgtcactgccacacaggacagctttctgtcagtagtattaaaatatcgctgccagattttgtttacaaccagaagcaaactggatgaatactgtactctgccattaaaagaaatagaggatatgaacgctctcttccagctgacatcagtattttattcagaggcagacacgtaccggccaacagttgaaaagatcatcgaaactgttcactctcatacttttgccgtggaactggcagcaaaacttctggaaaatggaatctcaactccagaccagttattaacaagacttcaggtggaaaaagcatctttccataacgaagataaaattaaaataatcaaagatggacaaagcagcaaagccacctattacagtcatatccatacgctgttttcgttatacactttatctcttaaacagcaggatatcatgtgtaatatgtgctttcttccttccaccggtatttctgcccgtatatttgccaaatggctggaactgcccacactaaatgagatcaacgatttaattgagactggttttgtccagacaacaaaacgtcgcactatctctctgcatccgatgattcaggaaatcaccctttcagagacaaaaccatctgtaactcgctgccacatattactggattctttacagaaaatatgtttaatgcatgggattgaagttgattattacaagaagctgttttagacagcaggaaacatcatagaattgattgaaaaagatgatataccaaaatatctactttttctggaaaatgtttttccatatatggataattataattaccagaaaggtatgaaagcaatcattcaggaattgaaaaattttttgaagcgtaaagacattggcaccgattctgaccgggcattgttactggattttcaggctactcttgaaatcaagccagaaaaagcaataaaactggaaaaggatgcacttgcccagatagaaactatcactgctgacaatgctcgccttgtttccaaccttcatgccaatctcggtggactttaccgcatgaacggtcatcccgatcttgcaagagaacacatggaaaaaagtatctcactacttgaccaatttaacctgcttcatataaatgacagcatacctcagattgccaattatgcaatgttcctagcagaacagcaggaacctgaaagaggaatctccaaattacaaagattatccggcatcatcaaagaatatcattccgatgactgtctggattatgccaaagtacaggaaacccttggaaccatttatctgatgactgccaatcttccgcaggccaaaacacattttaaaagagctttcaaaatatataaaaagatctgagctgatgaaccagaaatgattaaagcaaaatattaggagattcaggagttatatccacagattggattttccattggaaaaactctatctggtcttttaacataatacgtgcaatttaaggcgggcaacttgcccgccttaaatctttaaattatgcttgatttttccagaaaatattttacttactttgtttttcatgagtatgaatacaatttttacttatttccgtatctgcgaaaactcttataaataaaaggcagtaaggctattgccatcacggtatacattaccattacaagcggaatttgtcgaaatacacaattcccaatctgataaataagtgggacttttacacttgcctgtacatttgtcaaaattgttggtatcaaattgaaaagcgttgtatacccagaaagtgcccgtcctataaatggcaataagcaatataaaaagaacggaatgcaaacagcgacactaattgtatgcattttagccgctactaacatagacactacagccgccagcatactggctataaatccacatacaactgtcaacaaatagtattgtccatatgacataatgtaaatactatacgcctgatacatttgataaggtgtattcataccactggttcccataattccaaaacaaatcacactaagtaatataattcccatacaataaatcataactgtcgtagctattcctgccagtatttttattttaacagcttttgtacgtccatactttgtagagaaaaatactgcatctgcttttgtctgaaaatcatctgcaaatattccagcacaaataaaaccaactatgattgacagaataatagaatacgtttctacatacataatcatagtatcccacgaactataagattcgtattctactggtaattttatttcattatatttcttttccaagtattttttctgaacagaagtctttccatattcttctgccatcttttccatatttttatgataagtgtcatagaactcttgtatattttcttctgtaatttgattcagaacactttcatcatattctgcatccggtgttgataccgatattataaaactcctaatatcatctatcggttgtaatgtcgttccataaatcgcattttcttctgaggattgtgtcatcgcatttttattttgttctataacttttccaagttcatcttctgtcaatgtacctttccatgctcgtctgttatctgtaagttttcttgttgccataattccagtactagcatttccattctcatccacatagcgattacttgtaactgcaaatccgctaaaaatgacagcaagtatcaatgccaatccgattgcaaatacattaattttctttgaaaaaactcgttttaattctaatttaagcatcttgtttttcctccgatttttctccaaaataaaatagaaatgcatcttccagatttttttctacagccacagcatcttctgttggcttttctattgaaataattctaatctctgctccggtttttgttgtttttatatttccaaccaaatattcattcatatatttgtctatcatacttctcgaaacattacattgccataccttttctttcatagaagatactaaatcttccgcagtacctgcataaaaaagttctccatctttcattaacataatgttattcgcaatgtactcaatatccgatacaatatgtgtagacaagagcaccaaacgttcttccgacaattcactaattaaattacgaaaacgtattctttcattcgggtctaatccagcggtaggttcgtccaggacaagaatttgcggatcgtttaacatcgcctgtgctattcctacacgtctaaccattcctccagacaaattcttcatttttcttttactgaatttttccattcctacttgatttaataattgcttcactttttttctggcaaacggtatttttaacccttttatagaagaaatgtacatcatgtaatcatatacggtcaaatctgggtaatatccaaaatcctgtggtaaatatcccagaacttctcggtattcacctcctagtttccatatatctttaccattccataatatttgtccttctgatggttgaacaatcgtacaaagcatacgcattaatgtggtctttcctgctccatttactccaagcagtccataaattcctttttccataacacaattcactttattaacagcatttacttctccgtattgttttgttacatttttaaattctaatttcatacgtgtaatcctccaaaattttttcatcaaatagcaatgacttctgaacaaaaaaaataaaatatacaaaagtcaatatcagcatagccacccataccggagttacaattttctgataaataacatcatttgcaacaatcatcatccataaaccaacccataccagacaggaaagcactgctatatattctgatttttcccatctgctgtacaatacacgaaaacatatacaacatgaaacatttactggaagcaaaaaattaaccaccaaatcacttaacgagagtattgttgtttgatatgtaattgccaaaaacaccataacgatcaccagatccactactccaaacattaacattcttgctgtacaaatctgacgcagtgtgtaataagacgcctgctcaatttcaatcgcaccatttcttctgtttttccaaatttccgggacaatcagaaccacaaatattgtggcagatattcccataatcctcatcatatcttttatgtctgacgtataactactcaaccatatccatagacacataagaatacaaccttgtaaaatccaccatcttttttttatgaattttgtctgctcatacaaaaattcaaaataagatgttctatgcaattgtttcgataaaaccgactctgacaaaatattctgacatgcttttactgttttgttctctgcttcagtccttacatacttttcttcaatctcctctttatattcctttatttgttgcttataattcttcatcttttttcacctccaactctttcattaaaagttcttttgcttttccgattcgatattttacaagagaaagtttgatatgaagtaattctgcaatttctctttgcttcaattcctgaaaaaaatataaaactgccgtttctctaatttcttccggtaactttctcactgcctgttcaatcgttaatcggactcctagctcttctacatgatttttactacagtcctctgattttagcagttcctctgatggaatatcttttttctttttgtaataatttttaacggtatttccggcaattgtataaagataattcttaacttttccatattctttatatctatataaattggaaaagaaacgtgtaaacacttcttgtgtcaaatcctctgcctcatagggatcattgatatgtagcaaacaatattgatatatgcttgagtaatattttttgaccagtttttcacacgcatcttcatctcctgctcttgctagatgtactaacaaagaatcagttttgtattccattcgcaaatttgcctccctctgttttctaaataatataacaatcctactataaaaaaagttagaattttcttttgtttttatttatatttttctaaatattcttccaaacataaattttcttctttcattattttagcgacagtcgttccaacataacggtaatgccatggttcattactaattcctgttatatccgttttatcttccgggtaacgttttacaaacccatatttatatgcattttcgtctaaccattgatatgctttttcagaagaacatttgtcggtatccgcattaatatcaacactcagtcctaattggtgttcgcttgtatcgggaattgcaacatatttctcggctcttttttttgcttctttcgcagaatatccttgtttttcatattcattgattttctcgtccataattttttgttgttctcctgttgttcgatatccttctctaacaaacagtgctagcccctcagctcttgcatcattaaacatttgttgtaactctggataaatccgtgaatctacttttttaccattcgacaattctgtcaattctacttgataattatttggaatataatgatttcgatcgaccaaaataagattccattcacccgaagtgtctgcaaaggacttttctgactgcaaaattttcggtaatgttaattctccaacctgcacatcgatttttattgttctccacattacaacggttattatgatagtcattaaaagaatgaatacacgtaaaatattctttcttctgcgattgctgtatcttcttttgttcattttctctcccacattttcattatcaaaatatttctacttttaatataattaacaaccaaaacaacaaaagagttagtatctaaacttatttatcaataaaaagtttattttttctcaattccagctcaatttcccctcaatgcctttttcctccgattttcgtatgcttatcccacagcagagcagtaccacaccggtacgacctgctgaatcaatcaatacgaaaaaaggaggggataaaccatgcagaacaatatccgcaacacaaacctgcgctttaattatgatgtttccccgttttcttctggacatggaaataaacgaaactgccaaaatgctttatattatcctgctcgaccgggcaaggctttcctagaaaaatgagggctggtcagatatcgatggtcatgtgttcatttactttacaattgaagcactggcagaagttctccacaaaagccagatgacgattaaaactgctctggcagtgctggaaaaacaggagcttatcttccgaaaacggcagggacccggacagcccaaccggatttatgtaaaactcccaaaagaaaccatccactatacagacagatttctttccctaagacagacagaaaactgtcctattgacagacaggattctttccctgatacagacagaaaactgtctggtaataaaaaagagataaaaaagaacaatttagaaaaaagagggagtaaggagccactctcaccctatggaaaatttcaaaatgtttttctgtcagaaaaagagcttgaagatatccggcagacaatccctgactggaaggattatattgaacgcttatccggttatatggcttctaccggaaagcaatatcagaaccatgcagctaccatcatcaactgggcaagacaggatcatcctgcttcccggcgaagaaattacgaaagtgaggaatacgaaacactatgacaagatttatagaaaaaccaaccgctataacaccaaacagagagcttcagcctgatgaatattttaacaaaacagaccacctgatctactgttccaaatgcaatacgccaagacaatgccggcatgaattacagggaaaggttcttattccttccatccgctgtaaatgccagcaggaaatctttgagcaggaagaagtccagagaaaacttcatgaaaaacaaatggaaatagagcatcttaaaaccagcagcttacaggacaaagtcctctatgactacacttttgccagagataacggcatcaatccggaaataaaactggcacacaattatgtaagcaactgggaagagatgaaagcaaacgcttccggacttctcatctggggtgatgtcggtactggaaaatctttttttgcaggctgcattgccaatgcccttctggaaaaaggcgttcctgtactgatgaccaacttttcccggattctgaatacccttaccggaatgcattttgaagacagaaaccagttcatcaactgtttaaaccgctacagtcttcggattattgatgatctcggaattgagcggaactctgactttgcactggaacaggtattcaatgtgatcgacagtcgttaccgcagtaaaaagcccctgatcataacgaccaatctcactttatcagaactgaataacgccgctgatatcgcacacaaacgaatttatgaccgtattctggagagatgtcagaatccagatacgtcctgattttcgggataagctgattgaacagctcaagggactttcggtaaatattatgactatcaccgtcgtgatattgcagccaatgaggtggattatctcaatgtggaggatcctgatgttttctcccatcgtgcatgggatcttgaatatcagaggaaacaggagatgcgacgaaatcagcctgttcgagctaagaaaaggtcacatgatatggaattataatttcctttaaaaagaggcgcatggatccatcaaatccatacgcctaatttgcacattgttattattctttccgaatcctttcaacaatgctttcccgactcatcttttcgaactgatactttggtaccacatacgcaatcccaaccaaaatcggaatcataaacacacatggcactatcgtaagatgcaaccggaagaaaaatgccgtaccgagtgtatttgctaaaatcttctctgccccaaacacaactaataatactgcaatcacaaatgcgcctcccaaatataggaatccctcagccactagcattttcgatatctgttttttcgtcattccaacaacttccaaaagtgccagttctttttttctgctaattacagaagttgctgttgtattaaagaaattcataataccaataaaggctaaaataacgacaagaaaactaccgatcatataatatttactgacataccgctgaaagctctctttcatgtccaatacagaaaaaacattcatcatatcattttctttcaaaatattttcatcaatgtattcttttatctgcttgtccttgcccttctttgcatcgatggcagcatacatggctgattcatttcctgtctgggtaatatactcatcttctggaactaataccgtaatatagataaggtctgcatacggataatccaatgcatatggcatcagtgcttctccaatgacttcgtaatctttttggtttccatttttgtactccatttgaaaaacatccccagtctgataataagaaaccggatgctctgcatatttatcaccataatctacaagcacataatttccgcttttaaatgtatcccaagagcatttttcccctctccattctaatttgtcaaacaccgactcgctgattccgagaaaatgaacacttactgtattggaagcctttgcatcttcccaaacctgttcttcataatcggtccagtttttttcatatttatctgcgaatgcttcccatgttttcagaagttccggctccatcttgtgggtttcttcagaataatacacatatcctgtcttagcactatcaggacattcgtccaaaatctctttgatttcaggtgtaataccgttgaaattcgtatttgacaaacttcccgtcatctgatccagttgaaaatcggaagctaaaaacacttttcggtaagaatcaaaatcatatccctgcaccaacatcacgatacagttgacaaccaccatagaaagagcgatagaaagcataacaatcaatccctttttccaatttcgtaacacattttgaactgccatcccccaccaggttacagaagtattcttttttattttcctatgtgactgctctccttctgccaaacgcagagcttccacaggcgaaactctttccaccattctacaagcctgcagactggagagatacaccgttaaaagcgttaaaagtatcgctgcaaggaaaatcaaaggattcgctgatactactgtctgagccgtttttcctgcctgtgcactaatttcaacatctgcagtcaaggacggagccatacaaagacctgcaagataaccacaaaacaatccgattggaatgccaatagctgataatctccacgcctgcatacgtacaattttcttcaactgctttcccgttgtccccacattcttcaacaatccgtaagcccggatatccgttttcacagaaatgttaaaaatattataaataatcaggtatccagctaatatgacaaatagaatcattataattaaagaagaaaatgaaaatgaatcctcttcaaagagattatatgccggattgacttccattcctgtcccagctctcgtaaatcccgctgctttggatatcttttccgttttcttttccagattccaaaggttcttgtaccagacagaatactctttccctccattgtagatgccattttctaattcttcctgcgtaacgggataacaattctcctttgcataggcttcggatacccagaccatctgacctaaaacagctttatccccctgccagaatccacatatctgaaacgtatctgtcttatattgtttcagcatgggatttacttcccaggtcagcgttacttcttcaccaatctttggtgtaacacccagagattccaatatcgtgctgctaagtgctacttcattttctttctccggcagtcttcctgtagttggcagacaattaaaactttctgccatattttcatctgcatatcggacctctacggaaaatccaaaccgttcgtccattccagctcccagaaaaataccggaaccatatcgttccacctcatcactttgttctattgttttttgcaatctctccgcatcttcttctgacaaattctgcgcaatagcatgggatgaatccataaattgcttaatttccgttgctcttttggaaagtatcatggatacgctccccacaaagaggcttgtaaataacagtgatgtcaacatgattgcaataacagcaataatatttcttgctcggttcattttcataaaacgtttcgtcaataatcgtaacgtttctttattctctacttttaccatataatcgccctcactataccaaaccactgtctgaaacaatttttccgtcttcaatctgtaaaatcctgtcagccatctgggcaatctcctcattgtgagtaatcattacaatcgtttgatgaaaacgcttactggtgacttttaaaagtcccaatacatcctgactcgttttggagtccagattgcctgtcggttcatctgccagcaaaatagcaggttttgccgctaatgctcttgcgattgccaccctttgctgctgaccccctgacagtgcacttggaagattttccagttttgtccgaatacccagtgtatctatgatttcatttacataacctttttcaatcttttttccatccagttttacaggaagaacaatattttcccatacattcagcatcggaaccagattatactgttgaaatacaaatccaatatttctacgcctaaaaatagtaagctcttcatctgacatatggcttaaattctgtccgtcaacaatgacctgaccagatgttggattatccaaaccaccaatgatatgaagcaatgtagactttccacttccagaggttccaacaatcgctacaaactcccctttttctacttccaggtttataccctcaagagccctgacttctgtttctccctgcccatatatttttcgtaaatttactgcttttaatatattcatgccatcctcccatcaaaaaagcctgtattgatctttacaatacagactttatcataacaatgtctccatctggtttctgaaatgtcacagttttaatactattccttctttgctatcggaagaaacacagaaaatgtagaaccctttcctctctttgatgtcacttttatataccccttttgtgcctgaatgatctctcttgcaaggaataagccaattcctactcctggctggtctgccactgacagactccgataaaaccttccaaatatctttggtatttcttctttttctattccaatgccatcatcaatgatatcgatctttacaaagaaagaatactgctcggcttttatctgaacatttcccccacatgctgtgtatttaatcgcattgtctacaatatttccgagtgcctccacggtccattttgaatcacatcgaacatgcaaatccgtgtcacataggctcagagtaatattcttctcccttacttttacgttaaactgctgctgtatagattcaagcatctgcttaatagtagtatcctccgaatgtactgcgataattccactctccatccgtgataatttgaccagtgattgtatcagaaaatccaatttctccgtctgctccaaaatggtagctatctcctcttgattttcattactcacttcagagagtatttctccatagactttcagatttgaaatgggagtcagtgtctgatgcgcaatatctgaaataagtttttgtatcacttctttctgttcctgttgatttttttttgccagaaagctactgtctatatattgtttcatgctgttttcaagagcagaatacttttcctctgatatttctgtccgttccagttctccatctattgcacaatccagcatttgctgcaaccggttcaaaagctttttttctttctgataaaaaaagctgtaccaaaaaactccgctcaggacaaatataactacaatcaacataattgtttctatcatccattcaccgcccaggtataaccaattccataaaccgtcttgatatattcaggcttctgcgtatcatcttctaatttgtctctgaggcgtttgattgcaacagtcaaggcatgggcatccacaaactctgtatctccctgccatacctcgtcaatcagatattcccgtttcaatacttttcctctgttttcacacagcactctaagaagcttttgttctgtcttactaagttcaataggttctccatctttgaaaaattccattttatcgaaatagaactcaaatccatcaagctccatagaatttttagctgctgcctctttatttctaagctgcacagacactcttgcacgcaaaaccatcaagctaaacggtttcgtaatataatcatttgccccagcttccaatcctgttacaatatctacttccatgttatttactgtaagcaggataattggcacctgactgtttttccttatttctcttacaaaatcaatcccattcccatccggcaagttcacatctaataaaaccaatgtgatatcttcctttttcaagacttctctagcctcctgcaaagtctggcactgataaaagaaataggaatcatccttcaatgcgagacgtattccatcatttaattttttgtcatcttcaacaatcagtaacttttcactcatattttctctgctttctttcaaattacgctaattgtatcattgccagttttataaatcaaatcattaaatcaaaatctccagcagaaattatcttataaacagcaaaaagctcccgaaggagctttccacactttaaatatcgaccaattcttttaacacaatctcttctgctacattttggatattacttactgcactgacaagatttggatagtaaattccatctgctcccagtgtgtaggttccacccatcttttcaaatgtgcttttcatgtgttatttctccttgaaatcagcgatgtccttagatcatcgcaaaatatttcagggcagccttgatagcatcttctttctctttcggacactgtggcatttttggattttctgtctttggcagattatagttctctcctacttcgattccacatttccttttgatttgagaaatatataaatttgaaaccttcaagccaaattccttcagcacataatctttgatttcctgataggtcgctttctttgcagacaaactatttttagttttgcagcaaatcaaaatcctcgtctgtacactttcggatgattcgttttgtcttttcgacaggtagcggaacattctcttcatcgaaatattcgatgttcactacctctacaactgcctcatggttatccttgcctgcgggtacaagcacgaaatcaccgatttcaatgctgtcatcttcggtcagataataataactcttatatccttcgtcaaagataacactgcaaaagatgtattccgacttgcggcgttttgctttgccgtagaccgatgggtcaaggatttctcccaaaccgtagaaacgaatgaagtcaaatactgtttctgcaaaatctacgaaatcctctggcaacccatttttatcgtagcttcctgtaatggttcgtctcggatttttcttatactcaattgttatggtgtaatcctttgtttcgtttggtgtgtctatcacatcatcgggatttccttcaatgtgggcaaacaagtcctccgcatcgaaattttcaagcaagctctcaattccgcctttgatttcatacttacgagaaaccttacatccagtgccaatattctgaatatgctccaatgtttccgtggctctatcgatagtcagctgctcggtataatcccaggttacaaattcccagtctgcgttttctggtttctgaccaggttttatttttgtgaccctgtggtaatccagagtgattttatttatcacgtccggtttgcagtttccatcaaaaacatacaaatcatcaataccaaccgtatcacggacaaggtctgataaatctgtaccttcataatcgaagtcagcacacaaagagcccctgaatttatatgtgacgccttcggtattggtcaattccataatccaatcaccaatatccgtagcaaaaatttctgtatactcattaccgaagtaaactgcgattgcactaaacaacttgtctgccgctgacttatcaattttgaagttcttacttctggctttctcgtatcgttctccgcaacgaccaaagttgtatccggaaaaccaaacacgcccttcattattgatggttagatgctgttctacctcttcatcggattccggcataggtccatagcaaatattatttgatacgatacgtatcttctttagtgtgccttggaatataaaaggattctccccggacagcaatgccagtctgcttaatgccagaataaaccacgcacgatttttcggctccaagatttctgcacctgtatatgcccaatgattgaaatagcgccattgggaatagattgcagaaccaagcaagggaatatcggtcacatcagcgataatcctatccaaagcctcatggttgtttgctacattgccgtatttctctgaaaaggcatgaccaaagtccatcttgaaaccaagagtatcacaatcgtcagccatataatggtcaacgagttctatgtagttgatgttctggtctctgaacttatcgcaccatttcacagcgaaatcgtgtatctgtttcatatcagccactgtggtatacctcccattctttatttttgtggtatcgtatttacttatgtgttttagtcaacagaaccacgcactccacatgcggtgaaagttacttcttatactaaatagcgaaaccatcaccttttgcgaaaaggtttataccccacttagggggatagcgtttaccccacattccctattcttcaaacagcatatctttcattttttcatttgcttcctgatacaatgattccataaaagatgtcattttagtctctgaatatttttgtcttaaataattactgaatggttttaatttttcattttcataatactctttcaacaaaccaaaaatatcttgttgctgctcgactaaatacattaacatttcatattcttcaatattaaaattgaagtagtatttagttttttcacatttcttctctgcttctacatttttatgtatttcattataataatcgggaaccgcattaatattatccattgttacagaaattatatatgcatcttctactcctgtaaactctggcttaacttcaataacagtagccaaacaggtatctgcctgaataataggatttgcgaacattctattattatttttttcaacactttcatttttggtcatacaatctaataaaacagaaaatcctttcgcctctattactaataaattattatctttccgtatataggcatctgaagattttttattatttttttcataagcaaattcctctatatagaaataacttccttttgtagcctcttgcgttaaattttgaatgtacttttcaaaaagtctcccaaaaaatgccattgctctactatcatttttcggataacaatctctaatcatccagaaaatcttttcaaaaagtgcatttctcaatgtgatgtcacataccgatatatagtttcctttgccatctttgataaaaggaaattcgaagaacttactaaaatcccattcctgattctcactttccgatgcccatgttgcatagtcttttacctgttgtgataatactccaataactttgttgatcagttctttttctttcatttttccataaactttctcgacatttcgccacattgtatcatatatcaaaccatttacatcactataataaatgctcaattcccaaaaaagcaaaaaactatattgtgtaggtgtaaattgatacttttccgtaaaagctgaataataatccctatactctttctgaacatctacatcaaaattgtttatgtccctactaattttttccatcatataatacattcttagaaattcatgtgcaacatttctctgatagttcagatgatacgttgaataaagaaaatggcttttatcaaattcttctgaatgcttctgattaagttgttctgccactactaattgcaattgaataatctttttataatcttcttgtactatttcatattgtgtatcacatatagtttcataatttccaaattgaacaaattttttgagtaatataagcaacatttgaaccgaaataatatgtacatttctttttaataatggatttgcaaataattcttctggagatttcagaacaataccgcacatctctttctttaatacagtttcaaatggaattctaaactctccccaaaaaattcgtaccggatcaagcattgcatctcttactctaattaattcacaaataatagaaatcgccttatgcatattcatgttattgatttcttcttgcaaattcggcatttcatcagaaaaaacgtctgtatatcctaataacaactgtgcatcctctgcatcaactgaatacattttattatcctccttcaaccccaatttatagtatttttaatcattctgctctcgatatgttctgttttgttatcctcgctcgaaatctattttatcattgatgctattgtaccacagacatctcatttttactatttgaaaaagagcaagaaaaaagccgatcaggaatcgcaactcccaatcggcatcttttcttactcctcttcatttttacattcaatctccgttccatccaggaacactaccaacaatgttccgtcctcaaagaccttgatgtggtccagcgttttcagcatgaagtccgtgtccatctccgtcaaaggctctgccccatcggtgtattctatgaacttctctgcccgataaccttccaagaggttctcgctctgcagctgttccgtccactgctccatgaaatcctctcgattctccaccaacgcattccaagccatcagatatgcctttatcagcgtttcttcctccatgtgacggttggcacatcccatgactcctttgaccttgtagcgttcactgcactgccataccttacggtcaacacccatgctgctccgccagccttttcgtgcaaataccttattgcagtctccgcaaataatcttggatgcaaatggattgctttccggccggtggaaataggagtttgtcccatgctcctccaggtactttttcctgcgtttgatttcaagctgtacacattcccaaatccgctttgatatgatggcatcatggccatcctccacataaaacatctggatttcccctttgttctgcgtccgcttcttggtaaggaagtccaccgtatagcttttctgcaacaatgcatcacctttgtatttttcattctccaacatactcattaaggttgtagcctgccacttcgtaccgccatcccaattccgaactccctctttttcaaaaattctcttgatgtaatccgttgtttttccatccaaaaattcctgatacaatcgcactacaatcggttcctgcattctgttgattaccagcttgccattctcgtccgtgtcataaccaagaaaacgctttgtactcattttgtgttttcctgtttcaaaccttctgcggattccccatgtgcaattctctgaaatggaccggctctcatcctgcgccagtgaggaaagaatggtaagcagcacttcgccctttgcatcgagggtattgatattttccttttcaaaaataatccctatccccaagtccttcaactctcgcacataattcaagcagtccagcgtatttcttgcgaatcgggaaatggacttggtaatgatcatgtcaatttttcctgccctgcaatcggcaatcatacgattgaattcatctctctttttggtgttggttcctgaaataccttcatccgcataagttcctgcatattcatagagaggattttcgctgatataatttgtgtaataattgacctgattctcataacttaataactgttcttcttggtcggttgatactctgcagtacgctgccatcctcaacttctgcactgcctgtgctgttcctgattccgcagtcgaaatctactttgctggtataactgtaatacttcttgccatttcgagtcacctcctcaactactttctgttccgcaatatttaatccctgcagttctgcatcatcaattcgtatccctttacacgccttgactcccttttcaatgtaggtgctgcagagccattggattttcttcttgtaaacctgtctacgccggagcgtttttccgcagtaagggcaaatcagcattccgcttaagggatagcggttctggaacttcattgtgctgtcctgtccgatattcctgtcacgctttctctgttccctgacttcctgcaccttttcccatacctcaggcgttacgattggctcgtggttctccgaaatgtaataactctgcacttccccgttgtttttccttgtatggtttcttttgttttcaggggtgtaatacttctgcagatgaaaatcccctttgtacttttcattgcaaagcatcccattgatggtcccgctctcccatgttgttcccgtcaccgttttcacgcccaagtaatcaagcagctccccaatccttgacgagccgacattcattagataaaggtcaaaagtcagactgacaatttccgcttcctttcggttcacaatcaaatctccatattcgtttttgtcataaccgaggaaacgagaggtggtaatcatcacttcccctctctcaaacttctggtagtgtcaaatttactacctattttttctttaaaaacctttattttcgggagtttcaaataaaaagagcattgacctcccttttttggtataatgtcctcgaccaaaatttcactaaccaaaggagacaatgctcactagaaccggaagcacctgcccctcggcaaatctccgttcaaaagaaccattggaaaaatgatcctctctcagcagcattgtcaataatgctgtgcaaagttcataatctgccctcggaatacgttccaatttttcatcacagtcaatcggctccgtaatcatataatccccataattatttttcagatcccccattgtctttaacagatctgcatacagattctcttgcggattctttaattccaatatttcctgaatttttcgtattttctctgcctttgtcaatgctatacaccaccttaaaccttcgtagtttctcgaatatatgttctatattatcacatcgacgcagattattccatccttcagtctatatattcagcaaaatttttctctgcataactcacggcattttttatagcggcttcctttttcagagtttccctatacttttgcatctgttccgcataatcgtcagtttgtgacacgataatgttattaacagcagaaagaaccattccaaatttctttttatcgccatttgcaaattctatctctatggaacttccatgattatccgtaattgttcccagaccatatttcttatgctgaatacctgcgccaattttaaaaaccatattcagatattctaatgcttcctgcaatttcttcaattcgtcttgcgctgctttcagttcttctgcaaagcgaactgctttctctttcttttcctgtatcagctgtttttcttttgtctttggacgtttaaaagttataccggaaaaaaatccgtatgtagagcagcaataaattaaatcaaaagccagtatatgtttttctttatcctgcgcaaaagtctgaggatcaataccccatccattttcaaaccggctggtatccgtcttcatcatctcaggactatttttaattgcagatactatctgatcacacatgcggtaatagacatctaattttacagaatctccagatccccaatcgtcataaaactcaatacagtcagcaaatataagtgcatgactcgatttaaaaatatagttatgatctgaatcatacagaaacagatacgttgttactgaatgcatatcatccttatacagataacttcccggaaaatatttatcccgaagctcatggcttttcttcaaaaatgccgcaaccgcattctgccttttttccatagtcccatcagaattttcaaacagacttttaaacatatttctcactgtttccggctcatgctctgaaaaacgtatcaatccctgaaacggctgagtataactatccacaagattgcttgtaagtttcttgactttaagcaagtttgctgcaaattctgaattttcacttttcaacgcatcatccattaaaggtcgaaatctcttaacgatctgccatttataatattccatatgctcaggattattcagtttttcaaaatcatctatataatgcttaaaaatttgctccatatgaagctcattcatagtgttctcctccccatcttctaaatatcaccagttgttcagtaatagaatttgtgatgattcacttttttatcttttataaataactatatcataaaccacacaccttggaaatacagacaaaaaacaggcttcacaccacgaaccaactcgcaatgcaactcctcatcactcactattatattcttgtcacaaaatccagcgagatccacccattccgctctttctcatatgctttcagcagccccccactttgatgctccaacaccatcagcctcagcaacaatagtaaaacagccagcacccgtatattttccggtcttcctctgatccgttcccggcttcttccggatattcaaattcgaaatctccacacgaaccagatacggacgaaacacctcttccggcttcttatccacggaactgtacactgcctttccattctcatcaaacaccgaaaatcccagatgctcgtctgcacatttctttgcgttatccaacaccttaaatgcccccacctgactctccgcatcctgccagcttttccgcacatggtaccagacctctttttcagtcttcacacagtcaaatcttgtcagaccatacttctcaataataacgcagatcttctgcacatataaactgtccgttgcataaccgccgttcttaataatctgaacatccttccgataatctctttctccaaccagcccctcatatctctttttcttcctgttcattgcgcccaggagataagcagaatgatccgcaatcggctactccacacaggcatacttccgaaaatccgcagttaccgtataaagctttccagtcccatcatcctcctgtgtcttcttccgatacttacgggttccatcctaggcacttccgccccagctattcccagacagcacacacttcattccaaagcagttgtttgccttctgcgccagttccgtcctgccataacccgattccagaataaactgcgctgcagacacagatgccagaatcccgctggtcttcatatcctctgcacacagcactccaatccgctccgctgacttcccatcggaaagccctggaaacacagaagcctgcgtcccttcagctttcccagacatggcagccttcaccgctttccggaatccatccatcgtataagccagtcccagacctttccacagatgctctggatccccatggttcgtagtaatcccccttgcaggtccctctctatgtgaaattactacaccatccgccagaggatccagaccaaacttcttacacagcatggcaaacagctccaccgctgcttcataagtccgtactgcagatgcccttgccgtcaccagatccactggtgtaccgaatgcaggcaggctcacacatctccacaccaatatgcgtattatttccgcatcccttacttccggatccacagtgccatcccctgtgatcccagggaagtgtctaatacacagttccgtcatttccatcaataaatccatccacacaggcacttccaaaagaagccctgttccatgaatcaagaaatacctgcgcattcggctgggaatacccaaccgaatgaagcatcagtccttttaccgcaatctttctccctattatccgaatgaatgtgttgcatattcttttttctttgatccggtgtcaaattatccatatcaattaccccaaaaagactacatcattgtgatattcaagaaatgatttaccgggcaaaaatttatctggaagattgatttgtttaccttcatacccatagaaccaatctcttgtttgctgatccatttcagcatttttcatttctttagaaactatcagccttaatttactgtctaacgttattaaacctctatcaaaggccttatcatgtaatgaatttaaacacaatccattacatggatttgttctttcagttttttcatcacaaacattccaaggtttaatatgactcgcaattaacaaagatgattttgacattcctgttatacagcatttatttccgtatgagcttaaaacagccattctgaaaaaatactgtccaacacgatttttcattactcgctctttatattctcccggtggaatatcatcaatatctcccacatcaataatttccctaacttctacattttgcattcttgctcgaatttcctgagcctgatatgatagttctgtccaatcattgcaaaattcgctaaatatttctccatccagtttactgccatgtgccattgctgtaacatttcttttttttaattccggatcataatgcgctaaattatgcatctttaatcctacagatccaggcgttctacctaaaagttctgcaagcttttttatttctggatttgactggctaattttactaaatggtgttcgacaatataattcatatgctaaaattgtttcttcccggctccattttactccattccgatttgccatattatcttccttatcttaacgtgcttttccaattttgatttatttcttacactcactatacactatatcacatttttacagccagttattttttaatcgcataagttcttacagttcatactttcgctgctttttggcagcattttgttaattttttcattgacattaggcagcgtgcgtgatatactttcacaagaggtgagagtatgcccaatttaggccaatttataaaatccaaaagagaatcttccggattatctttaaaaaaattaagttccgcaactggaatcagcgacactgaaatattaaaaattgaaaacggtacccgtaagaaaccaagctgggaacatctttgtaaaattgcaaaggcattaaattttcacccatttgaggttttgcttagtgctgggtacatatcagaaaatgatattcatccaccactattgatcagcggactggaagatctgaatgagcaacaactcaatacagttcaactgttcgttaactttatcaaaacacaggaaaagacctgtctgaacgattaaggaggctacttatgcaatacagattaggagaattattttgtggtccaggcggaattgcatggggagctacccacgctgatataggcaattctgattattcaattgtacatcaatgggccaatgattatgatgcaaatacttgcgaaacataccggcacaatatctgccctgatgcgccacaaacggtttaccatgaagatatccgtaaattcgatatgagcaagctggcaccaattgacgctctggccttcggcttcccctgtaatgattacagtgttgtaggagaacagaaaggaatggacggtgtatatggaccattatattcttacggagtaaaagctctgaaaagatttaaaccacaatggtttcttgcagaaaacgtcggcggtctgcgtaatgctaacgacggtacggccttcaccaaaatcttaacagaactccgtgatgccggatacataattaccccgcatctttataaatttgaagaatatggtattcctcaggcacgccatagaatcattattgtcggcatccgcaatgacattaatgtaacctatcacgttccttctcctgaaccatatagcgagatagacaacacctgcagaaatgctattgaaaaccccccaatccctgcagatgcaccaaacaatgaagctacgcgacagtcagcgaccgtagttgaacgtctcagacatattcgtcctggtgaaaatgcatttacagcggatcttccgcctgaattgcagcttaacattaaaggtgcccggatcagccagatttacaaaagactggatcctgaaaagccatcttatacagtaaccggaagcggcggcggcggaacccacatttaccactgggaagaaccaagagcattaaccaaccgcgaacgtgccagactccagacattcccagatacttatgaatttcagggaaccaaggaaagtgtacgtaaacagatcggaatggcagttccttgtcgtggagctcagataatctttgaagcgattcttaaaagtttcgcaggtattgaatacccatctgtcgaagctaatatcaatgaataacaaaaagtcggaagtttagcagcttccggctttttattattcatcacttttcttcaacagaaaagtccatatagtactgttcttcatctatcttgtaaaaagtcacatctgttcttccatatgcaagaagatcatcttttttgacatacgctccattacataatccaagccggtttctaaaatattctcccagcaacgcattactggcaggagtggtaattgctttatcattctgctgttctactctcagctgtaacgtgtgatgatcatctgtaactactaaaaaatgctgtttatccaacgggaaaaatccagatttcgcaatatgcgatggcaacggaatataagcctcatttctgtttcttttattcctctgcccccagtttaatccagatctagttccagtttctccgcctcgtgccaagagtgacaaatgcacacaattctcagcatctgtttccatttgttcccttgttgtatcttctgctgaccgcaaaacaacatattcatccacttctgcatatgtgcaatacaccgtccttttctcggcatctgtatatattccatacgcttgaacagcatccgtctcatttacattctctttatcatcatgcaaaagatattgctgcgtaaaaggttctgaaatcttatacgcccttaccggcgtgtctctattcaaccaaatataatagctgttattttcaaatgctggcggatgtgtcaaataactacatgaaaaattcccccatgtgtctgaatatctggttccatgcagttccttaaaactttcatgagatcctttatctattcccttattcaaagtatcaccgataatcaatttgactgtcacatcggaaattccaagttcctcatagctttttagcagccacgaagccatactcggtgtagcttctgctgttaaaatacacagcctgtctgcgccctcttttattggatcaaacagaatttttcctgcaattccatccggatattttaaatcaccgctcatcaagcatcctcctcaatgacatcataatacattgtattactcggcaattttatattcggaacccagagtttctttccgccccatcctttcgttccagttacctgatacatcgtcagaaccactttatctgtaaaagttccacccagctgccagtcattaggtgacagcaatgcacctgtaccctgagcaacatttctttcccggcgtataatcaaaatcccctgtcctgtcggatgctctgacaaaatagtatcgataacagagcagaatgccaggagtttaaaatcaggactcggaataatatgtgccaatatttctttcaccagacgaagactcacctgataatacggctctgtttcagaaaacgcctccagaagttttgatatatcttcaatagaatcattatcaggattaaacggatagtaatttgttcctcctgaaataatttccacgtggtcattatccaatacatttttacgtgttggattaagcccctctggataatatatcttcacatcctcaatgcccttttcaacctgtgcaattatagaattattggtagcatttatatctgcaaacaatttatacaggttttcatcaatgtaaaccttcatcatgcccggatcacgatcatatccaaacattctgctgtgctgccacattgtatctgcctgcggttttttactcgttctcgtatagtaaatagtctgtaatcccggaaatgttacgccacggcccaatgtgtttccgccaacaacgaaattgcagccagcttcataatctgaactctccacatcattctttccattcataacaagaactctgaactgatttccagttaatatttctttaactttagcatacaagtcttccaaagaacacttttgagatcttgacggattcatatctgcgtactgtctgcttaattcattctttaattctgcatcaagattttcaatacaccattttagttccttctgtatatctccttcaatcttcttatgtacagctacccttacgctcggatgaaacaagcagttagatactttaccgcctgacaaaagaatctgagcagacaccaacagatgtcttacaaccacttctctcataggcattttaagcttttccaaaaatgatacacagtccggctttccacttgaagggaagaaaaaatcacctccaagataagcatctcccggctgaaaataatatgtaaaatatggatgccatccagatgcaagcgactgtaaaaagattgcctgcggcgttcctgtcacctgcagatataaactgcttgatgcaccattttttatgctgtccagatatttattaattgaagactgccggtttctgttgaccaacgtatttaatgaagccgcatcagcctcatcatcaatgatgaacagcggatttcctttcataaaacctgttgaattaagaatattcgcccacaatttcagcatccgcacattcttttttaatacaataattacaggatccatcagactgttttcattgaaaagtgccgcatcattttctccacaaatacagaatccatcaagatctgtttttactcgatccagagtttgctgctgaagaacaacattgtctgtagtcagtaaaacaaataccggaaatcctaaatctgccgccttacatataattccaaacatctgtcctgttttaccggattgaacatttcccaacaacagaccaatttcatgactggaaaaagaaaatgtttttatatgcttatttccaacatcatttgctgttttttcaatagattctgcaagttttgtatttcctctatcagttatttttttaaggtaggttttcaaatactgcatatacttttctcctattcatcttcggatcctgctgtaaatgaaagcatccagacatccagcggttttccatcttcatccaatgcagtctgacctgtcttcttgaattccagcctgtcgcatccatattcctgaagcatttcttctgtaatcattcccaggcgatccgtatcaactgccgtattatttactggctttactatacctgccgctgccagccttcctttcagccatcttcccattatcaattcatcgccaactgcactaaactgtttattattatcacttgttgtatgtgctttgaaccaatatccatcatctgtcactacaaaaaatggtttattcttctctggataaccttccatacggtacacatctgcgccaactgtcagctgagtttcataccagtctcttgcctttctcttacttcgcggtgctgcataacagacattaatatttgactttgtataatgctttccatcatccaaatgacgctcatctttcttaggaactttcagtttcagaaagaatgaaacatacgctttacatctttcataaaactcaacatttgattttggtacagatgtaaccagttctattccatttaatgcagtattaacttctctcacaagcggcatattctttacaagcgcaatattctctgagcagttttgcattttcaacttctcaatatgttctgcaatctccgctacttcctgttcagttgttgtaatagcagacatctcgtactgccttctattgcttgcttccaatttgataactccaagatttgcagatccgataattgccgaaaatggttttccgtctttataaaagcaaaacagttttccatgatacttgaatgcctttataactcgaatctcaccagtatctgatttctgccacttttcattgatttttattgctgtatgatacgctccttctggcatgccttcaataaaatacatccctatatttaagcaaactttagagataccacattcatccacaagcctgtctaattcggcaagtgatgcattagaagtatatccaactgcgatttcgactctgtcagctattttcatctgctcattaaagcagtccattattgtttcctgatcatcctctgttcctaatggcagaatatttgaatataataatttcatcctgcaccccctataaactcttaatgtattattcaattttactgcaaaacaactgataatgctaggacataaatgtattttcaatttgtatagtaaattattttcaaagatacaccaaacataaaaaagacgctaccatttctgataacgcctttccaaactatatcaatttgtaatctttcttccacccaactgccatttatcatgtttcttaatgctccgcacagcctgccgcagtgtattactgcggccatgctgatgatacggatgggacaccttatgcttatgaaatatgatacaggatcccatcaatggatattctggattatgtatataccacatatgccttgtattccgggacatgatggttacatcccggtcatccatataaataatctcaaaataccccagatctagacattcaagatcttctctgctaaacacctgctgcctcctttccaaaatacccttccaatgccttctccataatctcctgcactgctccggcatccatctgtgcaaaatacttctcatacaattccaccggcagtttcacagacacactctgcggcttcttcttttctttatacgccagaacaccctcaaccgcctctttcgtaatctcctttcccatcttccgcagttccactgcctgcttcggtttcagtttctttccctcagcctctgccacctgctggatcatcttttgcatcttcacattcagataagacaaatccacagcggctaccattgccagtgttcccttatccacagcatccttaaactccggaatcagccggtctagccgcatgtatctggcaatattccttccagtcattccatattcctcaccaagtccatcacggcttttctgtgacttgtggacatcgtgtccacaggtttcttccagagcctcgatttcctgccggatatcatttcgtttcccctgactgcttatcttctcataacgtgccaccagcactgctgccttctctgatggaagcagttccgcaaaagatctctgcaacaggtttgtctcgattacatatacgtaggcatcctcatcagacagatccgtcttcactatcgccggcacttccgacaatcctgctatcttcgccgcattggttctgttatgccctgcaagcatctcatagccccttgcagccttcctcacgatcaccggattcagcactccatgctccctgatgctctataccatgtcttccaggcgttctccctcatacagccggaatggatgatcatgaaacggatgtatttcctcaacaggaatagaaacaatcccgttcacagccactggcgtatccttcaccggatcctcagcaagaagagccagtgcgtcctgaaatacttttctttttggtgcattagctttcatccccagacacctcctctgccagattccgatatgctttacaagccttattctccggtgcatactccagaagcggctcactgtaataaattgattctcccacctttactgtgtttggtatgatgctcttaaaaatccggatctgtccatcaaaagtatccgtcagctgttctgtgattaccttacagagatttgttctggcatcacacatagtcagcaggatcccagcaatctgcaggcggtcattcagtctgcttctgactttcttcactgtccggcgtgataatcagctgaccattttcacatttcacctgtacataatccccaagatgaaatcccagttcttccagccattttccttttaatgtaatcgccggaactgtctcatatttataaccactctgtccacaaaccttcatatttcttacgtttttctttgccatagaattgactcctttcagatttgactaatagatttttagataaaaagaaaaagccgctgacacgttatcttctaacgcatcaacagcttctatcctgctttaattcagtgtattattcggttttgtaaaggtttatttgctttcagcattctccctgatacggtaataatcatccatatcaatgcctatttttaccttggcatctggttttcgtttgcccaaaagacacacagtctccacatgtgttgtcactaacataggaacacacatcctttacctcgtctacgatatgggaacacatttctttcgctttttctactgcttttgatttcttcccaaatcgttcttttgcgtttccaatttcatttttgaatcctgttttatatatgaaaatgattttatagggatctttctctccattttcatcgtaaccaccgacaataactttttcgatgatactttcaaatattcctctgtcaaattcttctaagatctgattttttgacaatgtttttctaaaatctgccagtcttctttgcaagctgccttcattgtcatattgttgttccaacatacttaactgtgcttttgcttcagacaatttcttttcataccccacatctgtttcctcataaatgtctttagctacaactccctctaaatagttttccagcaacttttttctcttatattgaatattataaacacttctattgagtttttcaattttatcttctatcgagtcctctgataaagttttctcgactctcttaataaattcttccaacacatctttatgatctgtacataacatacggtaagattcaataaaagcatcttctataacctgctctggaattcctttactatctggacaaaaccttttaccatgttttgttgattctacacattgccaaatagtttttgtatatttcgaactgctatgccaccttctccttgataaattcgcaccgcaaaatccacattcaagcatacaactaaaagcatattgtctactgaatttttctcgttttccaggtgctactccctttttgcgtcctccattacggcgttcccgtatctcctgagctcttgcaaatttttcttctgatacaatcggttcatgatgatttttgatgtaaaaccgatcttcttctccaagattttccagccttctttttgatatcggatctactgtaaaggtttttcctaataaaatatcacctttgtatttttcattattaataattcccattacactggaagaagtccatggattccctttaatagttgaaattccctgttcattcagttctcttgcaatcatcgtacttccagcacctgcaacatatctatcaaatatgtatcggaccgtttccgcaccttcttcgttaatagacagcgactttgttactacatcgtaatcatatccaaggcagccctgaaaaccaacaagttctccacgtttcatcttcattttcaaacctttttttacatatgcagatgtattttccacttcctgctgtgcaacagaacttaaaatagtcagtaaaaattctccatcttttaaggtattaattttttcgacttcaaaatataccgctatattcctctctcttaacattcttacatattttaatgtatctaatgtatttcgtgcaaatctaggaatgctttttgcaatcactagatcaatattgcctgaaaggcattcctgaatcagtaattggaattcttctcttttatctgttttcgtgcctgtaattgctttatcagcaaaaactcctgcaaaaacccattgcttattactctttatcaagtccgtgtaatatctgaccattgaattataacttttaatctgatcttcatcatcagtactaacacgacaatatgcggcaactcttaatctatcaatctttcttcccgtagaagtatcctcaccagcacccttcgccttaatgatttcaacttccatttcaccgctcctttctttttgtgttcctaccgtagtgttgatataatcttacaacgcaacactccgatagtcaagcggtaatattagaaataacaccataatctttttttaactttttctctaccagctgatactctgcttcacttataagttttaacgagcgtaattgtttcaacattgacagctgcatacaatatggcaaatagcaccattaatccaagaagtacccatggcaatgcagccgaaataaaatcaatgaacggattgccgtcaaatacattaccaagaataatcataacaacaccgattacgatagatatccatacaaatttgataacgttattttcggctttggctactttcatgtctctttcaattttattaagcaatgtcgcatctcctttcaataattcatccaggcttaaatcatataattcactcattcttataatgcttacaatatcaggtagtgattttccattttcccagttagaaatagtctgcctggaaacattgaggtcttcagcaacctgttcctgtgtaagtttctttatagtacgagcatttttaattttatcagctatcataattctgtatacctcctttcttccatgagattacagcaaacgtagtagtaacgtctatcaaaaggcttttacatattagataaaatcatgtaaaatttcttttacatagcttaattgcagtctatttagcttgtttcttgactactcatgaaaaatatttttactttcgccccacctgtattttcagaatttgaaagtttaatccctccgccatatttttcagccacagtttttgcaaaaaatagcccaatcccataatgggcttctccatttctacttgtgtcatccataaaaaactgctctgtgccatgcaataatgcttcttttgtaaatcctgatccactatcctccacaatgaatgtcagccgaccatcatgctcctttgcaccaatataaatgattccattttcttttgtatgctccactgcattctgaatcacattcattactgcccgaaacatttgatcatagacaatcattacctttttatcactttgctttgccttccaatctattttctggtgatagatttctgccagcccaagtgcctgctcctttatatctgtaaaaaaatcttctaacatcaccgttgtataggtaacatcactgcaattccatgattttgtgacatctatcaactgctggacataactttgtatctgtgttgtaccgtttaaaacataggtaatattatttttctgttccgtggtcagttcagtctctgaaagtagttctgcatttccccttacaatcgtaagaggtgttttaatatcatgcgccaaaacagacatctgctggttcttttcctgctctgttttccattgcttttctaaggattcccgcaatgcatctcgcatatcatcgattgccgataaacaatcatcaaactctttgataccggaaccagatgtcccatactccaggttctgattctttatttgatcgatggcatctaacacaggctgcatctgctttttgattctttttccaaaacatatggacggaatgatgataatcgctatcgctccaatcacagccataatactcatcacattctgaggtcctataaaatgctccctcaaaaaagccgaatgatactgaggtgtcaggcgatattgcaaaacaacatattcattttcccttgaaattactttataaaaatatttcccggatgcggttccatactttgcaacattccatgctatctgttcgtattgttctggaagatttccacctatttcctctcccttctctgaaaaaatgacataattacaaagtgcaggaatcatctcagcagtcactttatctgcatgcaaaatcgtatcatatgcttcattaatcttttgctctgcataattcgccggataaatgcagcccacactgatcaaaaggtaaagtagcagataagcaacaatcaccaaaccgactaatgatccaagcatgacaagtacatatctcataaaaatcttgctgagtgcattgcttctctttactcttcccatttatatccaatcccccagactgtttttatcggtgtataatcataatccgcaaattttgctcttatatttttgatatgcgtgattatagtactgtcattactctcattgtcaaagccaaagaccgcttccaatatctgttccttcgagaaaacctgtcctctgtttttagccagaaattcacagatttcgtactccgctttcgtaagaggaagttccttatcatcaaccaatagtttcttttgagatatttgaatacagaccctccccaaaaccatccggacagaatgttccctgtgctctcttctaagatgtgcattgatccttgcccgaagttccatcactccaaatggctttgaaatataatcatctgctcctaaagaaagtccgtttaccagactgttttcctccgtttttgccgtaagaaacaaaatcggacaatccacaagtatcctaattcttttgcataattcgaagccatcaattccaggcatcataatgtccagtaaaatcaggtcataacgatgtaattcttccatattaatttttagtggattacttactttggtaaccagatgtccatccttattcaaaatgctttctatcatttccaaaattgccggttcatcatcaactgccagtatttttgccatagtttccctcgattctattccgatattctgtttccttcccagtggtttacccaccaaaaatagtataccatactaatccctgtaaatattaagcaacctggtatgaatgacaaccattcacctacactagtttctcccaatacagattgcagataagtatatggtactctacccgtccagcagacaaatacatatttccacacataatctccaagtccggtaagcatcaatgcactaattagtcctgatataatccctgctccaatggataccccttttccaaactgaaaagccagaatcagctgccacagataaagtggaacactgcttccccacagcagcaatgctgcaaatatacatcctttcatgatttcgatatcgcttgatgcgattcttccaaatccaattccgaatatgattgctgtcaataggatagagcacagacacaaaaccagtagcatcaacagtttcgataaaaatgctgcaggtttatccggtaaagacaacagattttgaaaatcacctgtattttgttcctgttccatcacacttgctgtaaaaattccaataagtaccggaagtcctgctcctattgcctgataaaatgcaatcactttcatattttcattccatggtgaaaaaaagtaatatattaaaaatataacgctggttataatcggaatcagtaagtgtgccagaatcacagatgttcctttcatctttcgcaagtctgcattaagagatcttccaatcatcttatttcacctctcttctctcaaaccatttcaaaaacagaaccgttacaaaaacaaaccagatgattgagagacacattcccggaacaatgactcccgtatccaaaagaggattccctgcttctgcggcaagtccatttggtaaaacatgaagcaacgggcacatcattcgcatagggattgcagaaacaagtacataccagattctggtttgtgatattatcacaccgctgacggtaataaacaggcagacgaacaggtttacaatcattccaaatcgttcacttaaaaataaagctaccggaatctcccataactcagaaaccgtcagaaacaatactgcaatcaacgctcctccaactggaacatgtgtcgttagaagaaagcctccaagcgttgctcctgcaaacacaatcacattagaaaacaaaatcatgtacccaatataaataattttccccagcaacaattttcttctgtctgtgggaatagtcattaaatgatagtattttatctttttctcctgcgccacagaaagataacaaaatagagcaatcatccccggcagcaaaagtgtataccaccagttccaaacactttctgcataagcatttgtcatcccaagagtaaatataaatgccataacaaatgtaagaagaggaaatccccagataaacttttttcgcatggttcttttggctttttgatgttctgcttttataatattaaccatggatttcacctgctttctggttttttcttaccacattcataaacaaatcttcaagattatctccctgctttaatgctccttcgtatcctaagattccacctgaaataatcccgactttatctgcaagtaactgtacctctgagagaatatgactggagagaattacagtgattccctgttccggaaaagaccggatcagctctcgtaattcctcgatgcctattggatctaatccattcgtaggttcatccaatatcaaaagttccggttctccaagcaatgccattgcaatgcctagtctttgcttcatccccaaagaaaactgtcctgctttcttctttccggtgtttgtaagtgatacaatctgcaagacctcatcaattctgttttcatctgtaccaagcaataattgtcttaccttcaaattctctctggcggaaagattttcataaataggcggattttcaattaacgctcctatttttgataaatctttcctatccaaaagttttccatcaaagtaaatctttcctgcagttggtttcatcataccagtcaacattttcaatgtggtagattttcccgcaccattcggtccaagcagtccataaatctgttccttttctatattaaatgaaacattatttaccgctttctgctttctaaaatatttacacaaattttgtgtctgcaacatcatttccatctttactatccttccttccatatttcatttcttactgaaatataacctaacagaaaaaaataaagatttgatgaagattgctaaataattcgtctactctatttttattctcgtatggaataaaccatcaattgaatatcattatcagaactcggctttccactgaaatcagcaaagctgttacaaatacgaagtcctaatttaccgaatatctccgtgatttcatccaaactatataaccttataggatttccttctttcatttcaggcttataaagtgcttctccatacatatagtctacctgcccatatatcagcatttttctatccttctcccattcaaaagcagataatgtaagtcccttttctcctgcatcccataacttgcaagggaaatgtgtttgggcatagcttccattcatgatatccataaagtgctttccaccattttttaatgctttcgcaatgacagaaaaaatcttatgattttccccatcgtcttcaagatatcctattgctccatccgccatattcagcacaacatcaaattccttatcaaatgtgatcgtgcgaatgtcctgacaaatgaactttgcattcaaattttctttttttgcctgctcgtttgcataatctatatacgccggtgtaatatcaataccggtaacatcatacccacgtctggcaaacttcagtgagtgccgaccaaatccacatgccaaatcaagtattttttccgtcccttttaactgcaactgattgattagaaaatctacttgtctgttggtatcttctacccatgacatattgtggatatccagagtccaatttttctgataccagtcttttttcattgctttcatctaaatttatctcctgcctttcatccttcaaaaatctgtcccggtagttttttcttttctaaatatggaaacgctctatcaaattcttctgcttcattttcatccaccagataccctgctggtgttgcatattcacctgttatgccatctagataacccgaaatcagttctttacataaaaagaatgaagcatcatccccttcttccagaccatggtaacgaataccaaattcacttgcttgtttaaatccgcttttcccataaaaatcaatatttccttcaaaacataatgctccgcatccaagttcttttgctttttctaaagaataatccagtaaaatctttccataccctttccttttaagctccggtgcaatacagatcggtcccatagtcataatgggaatacttctgccatcatcggctacaatcacagccttcataaacatattctgtccaatcagatgtccatctaatgtcataacaaaatccaactctgagacaaatgccgaatcattgcgaagctgatggagtacataatgttccagacagcctggtcgatcctcccagtctttgtaaaagcaatactctggataacggattttaatggcttcccagaaataccgggcatatccacagcaaaacagatcctctacggtataacactgacattctttcaactgatcttcttctgcttcgtaatctccgacgcttggtgttccattacaatacaggttaaatgccatacggacaattcgtaaacttccactggtctgccacccttcctgcaggcattccatttttacacatccagttttaaaattatagattttattcacattatttcttgtgtctctgtcgatacccaggcaataaaccaaaacccgatggtagacatcctgatatctgcattttttcagatattcctcataaaatttttcgtgttccctgctcttgaaagtaattgtgcgagaattgctattctctgctcttaacgctgtgtttgtcattttcattttcctcctgaatttttaatattttggtataaaaaagacactccatttctggaatgccccataaaaaatagggacacccgcttttaacaagtatccctataatctatcaatgatctgatagctctctattcattttcatatttaagattctttgtgttccccgtcccgaggtctaacgcaacaacaacggttactttcttcacaaggctcttttctttgtgattttcacctatttttttgaaactgaaaaactccacaaagtgcgtaaattcaaggatttctaggtatctttcctttgtagtcctaccacagtctccacatgctcggtccaactaaacatatcaactggcacagcgctttttgcctcatatccatgtttggttaaatattttaagtctcttgcaagtgtttccggattacaggaaatatacaccactttttcaggtgcaagtttaatcacagaacttaaaaatgcctcatcacttccggctcttggcggatccataaatacaacatcgactttcttgccctgtccagccagatttaccatgaattttccggcatcaccctgataaaatctcacatttttaattccatttcgtttggcattgataatcgcatcttttacagcgtctttatttaattctacactgatgacttcttttacatgactgcttgcaatcagaccaatcgttccgattccgcaataagcatcaatgactttctcttctccctgtaatttcgccattttaattgctttttgatatagtttttcagtctgtactggattgacctgataaaacgaagccggagagaggcggaaagtacaaccgcaaagcgtatcttcaataaatccttttccatataaagtgatattacgttctccaagtaccatgcttgtctttttgtcgtttacatttaaaataaccgttgtaatttcaggatgaagttttctaagagctttcacaaaattattttttgatgggaagattggagaagcacatactaatactaccattacctcaccgcttgcaaatcctctccttaccatgacatgacgtagtaacccatatccgctgtcctcgttataaacttttatcttaaaagattttaataagcctcggatatctctgataattgcatccgcagtctggtcttctatcagacattcatcaaccggaacaatacgatgtgttccttcttcatagactccggaaacaatactgccatctcgtctgtgtgcaaacgctgcattgactttatttctataatgatatggatttttcataccaataatcggttctaccagacagatatctttcaaaagttttctgatctgcttttgctttttctttaactgttcttcgtaagaaatcccctgccaactgcatccgccacatttttttgccactggacatactttttgttcttccattttataacaactccaattttatttttttgtttcattatatcagatttcctctttgcttaaaagctatgttattctgtactttttttacaaaatatgctattattttattttgtaaacttttataaacctattaaaagagaggaatacaaaaatgctccaaacaattgaagcagttaactctgctgtaaacaactttatctggggtgtgcctgccatgatttgtatcatcggtgtcggtctttacttaagtatccgtacccgatttttgcaaatccgcaagttcccttatgcaatcaaaaccacaattggacgtgttttccgtaaaagagaggcttctgatggcgcaatgactccatttcaggcagtctgtacggcacttgccgccacagtcggtaccggtaatatcgccggagttgcaggtgcaatcgcaatcggcggtccaggtgccgtattctggatgtggatttctgctgcccttggcatgtgcactaaattttcagaagttacccttgcagttcacttccgtgaaaccaacgcacggggagaactgatcggcggacctatgtactacataaaaaatggtcttggaaagaactggagatggcttgctgctttattctctcttttcggtgtcttaactgtattcggcaccggaaatgctacacaggttaatacaattacgaccgccatcaattctgcattattaaattatcatcttatcaacgaagatgctgtttccaccagcaatctgattatcggtattatcattgccattttagttgccactgtacttcttggaggcgtgaaacgaattggacgtgtaacggaaaaactcgttccatttatggcacttatttacattgtactgtcccttggtgtgattttattaaatttaaaccgtgtaccttctgtttttgcttctattgttgaaggtgctttttctccggcatctgtaaccggaggtgtggtaggaagcttcttcctgagcatgaaaaaaggagtctcacgcggtattttctcaaatgaagcaggtcttggtaccggttctatcgcccatgcctgtgcggataccaaaaaaccggtaaaacagggattcttcggtatctttgaggtttttacagatacaattgtaatctgtactttaactgcactggttatcttatgcagtggaacccctgtcggatacggagaagcagccggtgctgaactgactatttccggctttacttctacttatggaaactgggtttccattttcactgcaattgcactctgctgttttgcattttccactatcattggatggggactttatggtgcacgttgtattgaatatctgttaaaagaaaaatctatcaaaccatttatggttgcttattctctggttgccattatcggtgcaactgctgatttaggtctgatgtggagtgttgctgagacctttaacggtctgatggcaattccaaacttaattgctctgttcttactttccggaacggtggcccgtttagttaaacagtattttgaaacagaaggaaaaaccaattagttttttcaataaaaaaagccgaaagctttaaggggttaccttaaccctctcagctctcggcttttttcttactcttcccgttctaattgtttcagcagatatcttcctacaatccctgaaaatcctgccacatcccgaatataggcaaaatcttttccaaagatctttttttctgccggtaaatctttctcttctcctgcaaatactccaagcacacaaacacctttacttcgtaatttacgtacttcaaatgcagtatctgaaatcgcatactttccctgatagggttgtggatttcttgcatttggacggtttaaaatcacatcataaggtcgtccgtcacttagtacaatcagaatcttatgttcctcttcccgatttaacaattcatagcctgctgccttaattgccaacccatcgcggttattggaagacgtattatattcaaaaatattttcattggcacttctatcatcttcatattcccgaaaacggtgcaaaatcgtataatcccagaaggtgcaaaaactcataacccgatgtggaacatttgcgatgctcaatgcttcacttaaaatatatgcctgcatcgccacctgcccctgccgttttctctgtgagccacttgcatcaattaaaacatccactacaaaatcactgttatcgtaatttagttttcttaaaaacactcttgaatcatgacttcttccaactctccaaagacgtgacggcacaattcttcccctgtcagatattgtttcctgtacttcatcacgcatcaccagtgctttttttagcatatctgagagctgtcggatgttatttttcaccatcctgtgattgttataatattcatagcggtttttatctcgctgtttttttgcatactcatactgataattacgaagaaccgcatgttttaatactccttctgtaaaatacagactacagtcactatgaattccacgacataataacaggtttcgtcttttctcttcagtttcagaaagatatccaattccgtaatttcgctgaacgtaactgtgcatcttagaaagtgcctcttcatctacaaccaaaattttctttttctgacttgtctcttcttcggattcttctttctttgtctcctggtttaattccattttatccaaattggtcattgcttcatttatatgttccagataggtgccaaagctctcttctaatgcctcttcttccagataatctttccaggaaaactcggcaagctcttccagcgaaactgcaagtaccgtttcaagatttccataacgtttttcaaaattaggatctaccatagcgttatataacttatctatcgtgtgaatcagctctatcgtttcttttgcatcagaaagtgcctgaacctgttccataaatgctctcatccggtttgtagcaggctcagaaccgtttaaacattctttaaacagcattagcttcaaacgccctggctcagaagctgcaaggcgtgaaaaatccatttccagtatatcttcaagcgccttttttcggatttctttgactccttcccgctcctttgtaatccgctcggctaccgaccattcaatacaaagctgtgcaaggctcataagaggtccttcttccccatgcagatagattttcttcattaagtataaagaaagctcttctctgttaaaataacgtgcaaatgcgccctgtttgattccgtcataaagcccaactgcatgagaacgatgataactctcaatgtccggttttacatccagcgtataatctccacttaccgtccaaatcagatttttgatccggttttctaattccaactcaaattcttctctcattcaaatacatcccctggattccaggactccggtattcttgtctttacgacatcctgcacaatttccttctcaaaaatatcaaagcatttatttacaactcccattttcactgcaagggacggttttaatccgcaggaaatcgtgcgcagtgccccaatcatccctcgcaaatccaatgcttttgttgtaatctcgctgttatctgcctttaactgcaaatccaagaagagtccaatccattgctttaacgcttcctctttgatagttggaaatttcgttttaaaaacgtactcaagtgtctcttcattctgacccggcatatctatcacaaggaagcgggaaactaatgcttcatttaactcttttgttcctgcataaccataattcatcgttccgataaaacgtgttgcgtcgtccatctcaattttatcatatcccggcacatcaatacttcttctatgatcgagggtagcatgtaaaacggagactgcatcattttttgccatattaatctcatcaaggattccaaaaccaccatattcggcacaacggtagatacttccttttcttaatttgacttcattattttcaaaggtatctgtaccaattaaatctccactgtctgtattgacatgaaaggaaatattataaaccggtcttgcgaaaatccatgccagattctcagccagtatgtttttaccggttgcctttggtcctgttaagagcagattttctccctttaataaagttgcaattcccatctctaatacttcttttccaaaaaatgccatatctggctttataatacggtttttcaccctctcatccactttatgttccgcacgaaattctgcaaccgcttcaatcaatcccttatctactttttgttcctctaaaaccttaagttcttgttccattttctccatcctgtatttttttacttttattctattctatttcaccatatccatctgttggatttccaacatttttgaaaatcaggcgctacacttatcatagaataaatttttcatataactagaaaaggcatctggattttccaaataccctttcttttttctcaatttctatttttatacatcaaataataaatcaccataagatggcatcggccacatatctttgtcaacaatcatctcaagttcatcaaccggtgtacgaagtgcttccattgacggcattactttttcatgatagaacattgcactttcttttccttcttctttggtcagtgcttcttctgttactttctttaattcatttaatgcatcttttgttttctttaataaggcagaagtttctcttaagagttctgtctgtacttctacttctaaaacacctgctgcaacaaccgcattaatagaatctgcaagctgtcttgtatatttaattactgccggaataatctgtttgcttgccacatcaatcatagtcttagcttcaatattgattgcttttgagtaagcttcgtatttgatttcttttctggattccagttctgcttttgtaaatacaccaaatttttcaaacaattcaatggtctgttcgcttgtcagtgcttctactgcatctaccatacatccgatgtttggaagtcctcttcgttttgcttcttccacccattcatctgaataaccatttccattaaatacaattctctgatgctcagtaaagtttttctttatcaaatcatgtacagccatatcaatgtcttctgcattctccagtacatcgcagacttctttaaatgcttccgctacgattgtatttaagacaacatttgccggtgcaatagaatctcttgaaccaaccatacgaaattcgaatttattaccggtaaatgcaaatggtgacgtacggtttctatcggttgtatcacgcataaattccggaatggattttacaccggtctctaatttttcacttccgatactgtggtcagccatacctgttgtaatcagctgattcataacgtcagtcagctgagttcccaaaaatacagaaataatagccggaggtgcctcatttgctccaagacggtggtcatttccaacatcggctgcagactcacgaagcaaagctgcatgtttatctacagcttttaaaatacagcttaataccagtaaaaactgcacattttcatgcggtgtatttccaggctctaacaaattcacacctgtatctgttgtcaaagaccagttattatgttttccggaaccattgactcctgcaaacggcttctcatgaagcaggcatttcattccatgctggcttgcaacacgttttaaggtctgcataataatctgattgtggtctacttccacattgacttccgcataaatcggagctaactcatgctgtgccggagcaacctcattatgctgtgttttagaagttacgcccagtctccataattcttcatttacatgtttcatatatccggagattttctgacggattgttccaagataatgatcatccagttcctgaccttttggcggcattgcaccaaataaggtacgacctgtgaaagtcaaatcttttctctgcataaatttcttctcgtcaaccagaaaatattcctgttctgcacctacagaaggaatgactttttttgcagttgtgtctccaaacagacggatcagacgcattgcctgtttatcaattgcctgcatcgaacgaagcagcggagttttctggtcaagtgcctctcctgtataagaacagaatgcggttggaatacataaagttgcccctgctgcatcatgtcttacaaatgccggtgaagtacaatcccatgctgtatatcctctggcttcaaatgtcgcacgaagaccacctgatggaaaagatgatgcatccggttcacctttaatcagttcctttcctgaaaagctcataaggacttttcctgatggaagcggtgcagtaatgaacgaatcatgtttctcggctgttactccggtaagcggctgaaaccaatgtgtataatgtgttgcacctttttcaatcgcccattctttcatctcatgtgcaatgacatctgccatctcaagagacaattcttttccctccagaattgtctgttttaattccttatatactttttttggaagtcgctgctgcataacagaatcgttaaacacatcttctccaaaaatttcagtgactttaatgttttcactcattcgactatcctcctgtattatgtgcctaaaagctgtttctacgatacctcatataagaaaaaaaagcaagtggaattttcagatatcgcttaccaaaatgcaaagaaagctaaaagtaaaagacaaatcccaccaatccaggacaagtcttttttataaaactttgcacagcattttccaagtttccacccgatttccatcataaaaatcccaaaaagaaatgcccctgcaatcagcatccagcgtactccctctaaaagtcctgctcccatcccaactgccacactgtcaatagacagtgccattgccagaataatcccactcataaaatttaattttcttgtttttttcgtcgtattttgctttcgtatccgaacagagtgataaatctgatatccccccattccaccaagtaaaacccctgccagaatatctgttgtcctgccttcgataaaataagaaaaaccatttcctatccagaccgccattcccaacattccgctcataaccagattcatccctgcaactaccgaaaatgaaattttaatacggcttgccccatacgaaaaactgaccatgaatgaatccatggtcagtgcaaaaatcaatatactgtttttcaaaaaatcctctatattcatatccgttcagcatccactttttttattatactatgataataaaaagaaaaagtccgatgccttttacgttttatttactgatacagcataaattaagcagctgctatattgatgccaagcgactttttgctatacaaggcagaaaaataaaacatcagacacatcaatatggcggttacttaatattctctgtattagcctgaatcaacggcactttctcatcttttttcaatataatgttcaccgcatgattcatattttggatttccacctctcgatgttctccaccaaattctccatccaaagtccaggaaatctgtgtctccgaagtaattttaaggtaagaagtcttaaaagactcaatgttggaagtatccgctcctcctaaaagagctgtaataatctcatttaactccagaatatttttcggacgacgtatcagtaatacttcaaacacaccatcatccagcaatacatctggtccggttagttttcggaatccaccaacggatgtcgcattgctgaccattccgaaaataaaatctccctcgaaactggtatcctttgtttctaccttaagctgataagaagcaatattaaataatctctgtgttccttctaatatataggctgcatgtcctaaaatattttttaagtcctgattagtctcataagaaacatctgtaaataaaccaaatgctgcaatataaacaaaaaagtcatcattaaatttcccgacatcaaaagcatgtggaatgccctctacaatatctgtagccgcctgtaacatattttttgaaacatgaagactatttgcaaaatcattcgtactacctgccggtatgtaaccaagtaacgttttatgatttccctccatcaatcctgttaccacttcatcaagagtcccatctcctccacttgccacaatcaggtcgaaatcccctgctctttttttcgcaacccgaagtccatcctgatatgcctgggtagaatgtactgttacctcatatccgccttttataaaaatatctataatatcaatcagacgtgatttaatacttccttttcctgctcttgcattaaaaataaacagtaattttttttccatacgtctttctcctatagaactttacttttctaattgatagaacaccactttgtacaagtataaaatcaggacaatacaaaaaagaacatacaattccggtgcagccatactgttaccggaggtatgttctttttacttcagcctaaggctgcattatcttttcaatttgtccacaactgaaattatactaattctaatacaacttccattgctgcatcgcccttacgtggtccgattttgatgattcttgtgtaaccaccgttacggtcagcgtattttggagcgatttctgtaaacattttatctaccatgtctacatcttttgtatttttctttctaccagcagcagctgttggaacttcttttaccgggtagaaaacttttaacatctgtcttctggcatgtaatctggacggagcatcttttttgatttctttctgaacttcgtcatatacagttacttttttaccatcaacaacttcttttactctttttccactttcgtctttacgagcaacttttgcagttactgtaacagtttcaaaattgtctttttctttcactgccattgcaataagaccttccgcaattttgcgaacttcttttgctctggtttcagttgtaacgatttttccatgatataacaggcttgttacctggcttctcagtaacgcttttctctggtcagatgttctacctaattttctatatttagccattttaatatttcctccatttgtggaacaatgagccatgcttcttcggtcttactggctcattgcttatattccataaattctctttacttggtttactcatcacttgggttcaactgtaaacctaactcttttaattttgcaagtacttcttcaagtgatttacgtccgagattacgaactttcatcatatcatctgaagtacggttgcaaagttcttctactgtattaatgcctgcacgttttaagcagttataagaacgaacagataactctaattcatcaatgttcatttcgagaactttttctttttcattatcttctttctcaatcatgacctctgctgtttttgcactttcagacaggtcaataaagaggcttaaatgctcgctcaggacttttgctgcaagactgactgcctcatcagcatccaaagtaccattggtataaatatccagtgtcagtttatcaaagtctgtaacctgtccaacacgggtattttcaacagtcatatttacacgctctaccggagtataaattgcatcaactgcaatcacaccaatcggcatgtcgtccgtttttcctttatcagagctaacatatccacgaccttttgtaattgtaagttctgcattaaacttacatcctgctccaccattcaatgtagcaattacctgatccggattcaggatttcaatatcctgatctgcctggatatctgcgcccttaacaacgccttctccatcaaactcaatatatgcagtttttggttctgcgctgtcacttgtgttcttaattgccaggtttttcagattcatgataatctctgtcatatcttcttttacacctggaatggaactgaattcatgcagaacaccatcaattttaacctggcttacagcagcacctggtaaggaagaaagcataattcttcttaaagagttgccgagtgtaataccataacctctttcaagtggttccacaacaaatttcccatatctcttatcatcagacatttctgtgatttgaattttgggtttgttaaaatcgaacatgcaaagccctccttgctacgtgcatcttatttagaatataattcgacgattaacatctcatcaaccggtacgtcgatttcttctcttgtaggaagtgctttcacttcgcctttcagagcttcctgatcaacatctaaccaagccggtacaagacgtccgcctgttacttccacgatatctttgtatctctgggaagatttacatttttctttaatttcgataacatcgccaacttttacaaggtaagatgggatattaacctgttttccgttaaccattacatgtttgtggtcaacaatctgtctagcttcttttcttgttctggcaagaccaagacggaaaactacattgtccagacgagtttccagcataatcatcaggttttcaccagtctgaccctgtttctgatcagcttttttatagtagttacggaaaggtttttccagaacaccatagatgaattttgctttctgtttttctcttaactgaagtccatattcggacatttttctatttgctctttttaactgtcttgttgattttttgtcaattcctaaataaatcggatcaagaccaagggatctacatcttttaagaactggtactctattcactgccatgattaattaacctcctaattagactcttctacgttttggtggacggcaaccgttatgtggtaccggtgttacgtcgcagatgcttgtaacttccagaccgcaggcagacagcgcacggattgctgcttctcttcctgaacctggtccttttacgaaaacgtcaacagtcttaagaccatgaattaatgctgcttttgtagcagtctctgcagccatctgtgctgcataaggagtagatttccttgaacctttaaatcccagaccacctgcacttgcccatgataaagcatttccttcagcatctgtcaatgtaacgattgtattgttgaaagatgactggatatgtgcctgtccgcgttcaacgtttttcttaacacgcttttttgtcactttttttgtaactttagccatttctaaactaacctactttctcaaatatttcaaatcatcatgttatcatttgctttaatttttcatctaaaatttaaagcttaattattttttcttattagcaacagttctcttcggaccttttcttgttctggcatttgtttttgtcttctgtccacgaacaggaagtccttttctatgacggattcctctgtagcatccgatttcctgtaatctcttgatgttaagagcgatttctcttcttaaatcaccttctacattgatgtttaattcatcaattgcatcacggattttaccaacttcttcgtcagttaaatctctgcaacgagtatcaggattaattcctgcctgctctaagatacggtcagcacttgttctaccaattccgtagatataagtcagaccaatttcaacacgtttttctcttggtaagtctacaccagctatacgagccatgtacttgttcctccattgttctaataaatattgttcctaattgagacacattgaaaatgacggtttcatgtgtccagccgcaaataaatttcacgcagcctttccgaatcatacagtccggtattaagcaatattctgcaatcatcctctcggtaggacgacaaacgtgataatattactatatttaatcagtataaacaacgcatccacgtggttcatactgcagccgcactaaaataaaactacacaaacttttcctcgtctaattaaccctgacgctgtttgtgtttcgggttttcacagataattctgatgctaccttttcttttgataactttgcatttttcgcaaatcggttttacagatgctcttaccttcacggaataaccctcctttcgtatttttgctgtgctctgattcgagggcaaaaatgcccgagcacaaaagtacgctttatataatagcactacttacataagattgcaagtgtttttttcaaatttttagctgcatatctttgtacttttttcagtacagatatgcagctattcttgtctgtaatcttatttatctctccagataattctgcctttgctcaaatcatacggagacatttcaattgttactttatctcccggaagaattcgaataaagttcattctcagttttccactgatatgagccagaattacgtgtttgttttccagttccactttgaacattgcatttggtaatttttccagcactgttccttctacttcaataacatctgcttttgacataaatcaaacctcctgtccgcttttgcggtttttcaatactctcttgatacgctcatttgttaattcatttccctcatcgagaagcttctggatttcgggagcaatttcataggcgacctgaatatgttttacttttttctttttctggttttcaattgtacggatttttccgtctgccagataaacatattcaccttctgctttcattatcatgtatctttttcctgtatcatgaccggcaagtgatacagccgtcattccggttccaagttttttcattaaaccgaacctcctattttgtaaaagtgagaatttccggctcaccatccgtaattaatacagtattttcataatgtgcagaaagggagccatcctctgttacaacggtccagtcatcatctaaccattctacatcggctctgccctgattaatcattggttcaatcgcaagagtcattcctgcctgcagtttcagtcctcttcgtctctgacggaaattcggaatttcagggtcttcatgaagacttgttccgattccgtgtccaactagatcgcgcacgactccgtaaccgaatttttctgcataagcaccgattgctgcggagatttcatataaatgatttcctgcttttgcaaatttaattccttcaaagaaactctgtctggttacatcaatgagctgttgtgcttcttttgatattgttcctacagcatgtgttcttgctgcatctgaatgatatccctgataaatcagacctgcatccagacttacaatatcaccatcctgaagaattctgtttgcttttggaattccatggactacttcatcattaactgagacacagatggatgccggatatccattataatgaaggaagtttggaatacatcccatctgacggataatcttttcacctaactggtcaatctcaagagtagaaactcctggacggatgaagttttcaagttcatcgtgtacctgctctaaaagccttccggcttcacgcattttttcaatttctctggcagtttttatcgttactgacatttttacgctcctaaaatctcgacgattgcttggaatacatcttccatatcaacagtaccgtctacttcttttaacacaccggatttagtatagtaatcaattaacggctgtgtctgatcatggtaaactccaaggcgtttctgtacagtttccggtttgtcatcgtctcttaacactaatttttcaccgcaggcatcgcagactccatctacttttgtcggattgtatttaatatgataagttgcaccgcatccaacacaggctcttcttcctgacatacggtttacaatgttttcatccggaacctccacattaattgcaaaatccactttttctcctcttttttcaagagcagcgtccaggcattctgcctgcggaatggttcttgggaagccatctaagatataaccgtctttacagtcatcctgtccaacacggtcaattactaaatctaccgttaattcatccggaactaacagaccctggtccatataagttttcgcttttttaccaagctctgttccatttttgatatttgcgcggaaaatatctcctgtagaaatatgaggaatgtgatatttttctgcgattttctttgcctgtgtaccttttccggcaccaggtgcccccaacataataattttcatacgcttttccctttctgtaatgcttttttactctttttttacattttccttatatagcattttagtgcacccacaaaagtgggtacacttccataatgttatgcctattcacttaaaaaacctttataattgcgtaccaacatacgtgattcaatttgtttaagagtttccagtacaacaccgactacgatgatgatggaagttccgccaaatgaaacatttgcaccgaatacaccgttgaagaaaaacggaataactgctacaattgtaagtccggcagctccaataaagataatgtaattcaagatattctcgagatactcctgtgttggctttccaggacgaattccaggaataaagccaccctgctttttcatgttatctgcaacttccatcggattaaatgtgatagaagtataaaaataagcaaagaaaataacaagtacgatataaagaataagaccaattgaatataccggttcatccggattaaaccaattactggaagaaagtccttttaaaatcttgcttccgattcctgtaccgttgcctttatttaaaaagctggcgataataaccggaaaagacatcaaagaagaagcaaaaatgattggaataacaccggcagtatttactttcagtggaatattactggactgtccacccatcatttttcttcctaccattttcttggaatattgaactggtattcttctttctgcaccattcaggataagtaccataacgactaccagaataatgattgccgctataatgattactgacaaaccacctcttgcgatggttttgccttttacgaatttgtcaaacaaagtaaccaaatcacttggtattctggaaacgatgttaatcataagtacgatagaaataccatttcctacacctttttccgtaatctgctcgccaatccacattaacatagcagaaccggctgtcaaagtggcaaccgcaacaactacgcttgtgaaattcatgtttgtaagccatcctctgtttccaaatccgattgccattgtaacggactggaacagcgctaaagctattgtcacataacgagtgatggcagtcattttctttctgccctcttctccatcacgctgcatttcttccagcttcggaatcgcaatcgtcaaaagctgaatgataatggatgatgtaatgtacggtgtaatactcaatgcaaaaatagacatggtctcgaaagacccacctgtaaatgcattgaaaaagttaaacgcatcgtttgactgatttgcaaacaattgtttaaagaaatctctgtcaacgcccggtattggcagctgtgagccaatacggacgataacaagcattaacactacatagtaaattcgacgtcttacatcttttatcttaaaagcatttttaagagtctcaagcattagatcacctcgacagttccacctgcagcttcaatttttgttttagcgctttcacttacagcgttaacttttacattaactttctttgtaacttcaccgttaccaagaagtttaacgccatctccaagacgagagattgcacctgaagcaagtaatgctgctggtgttacctcagctccgtcttcgaatctgtttaattcgcttacgttgattgcaacgatatctttagaatttctacatttgaagcctctcttaggaagtcttctgtataaaggcatctgaccaccttcaaaacctggtctcttagcgcctgaacgtgctttctgacctttatggcctttacctgctgttttaccatttcctgaaccatgtccacgacctcttctgaagttgtcgctctgtctggaaccttcagctggttttaagtttgataaatccatgatggcacctccttcttaatgattagatttcttctactttaaccatgtgtcttacctgacgaatcataccacgaacagattcattatcaggcatttccactgttttgtttaattttcttaaacctaaagcttctactgtttttttgtttttcggaacagcaccgattgtagatttcaccagagtgattcttaatttatctgccatttttcagtcctcctatgcaaaaatctcgtcaacggattttccacgaagtcttgctacttcttccggagtctttaactgacttaaacctgcgatggtagccagaactacgttctgtttgttacgggaacccatacattttgtacggatgtttttgatacctgcaagttcgattaccgcacgagccggaccaccagcgataacaccagtaccttccggagctttcttcagaagcatttcagcgcttccgaatttaccgatgaagtcatgagtgatacttccgttttcgtctcttgctactgtaactaattttttcatagcgtcttcttttcctttgcggattgcttccggaatttctgccgctttgcctaaaccagcgccaacgtgtccattgccgtcaccgacaactactaaagctgtgaatcggaagttacgaccacctttaacaaccttggttacgcgcttgattgatactactttttcttctaattcaagctgactagcatcaataatagtacgtttcatgtgttcatttcctcccttattagaattctaacccagcttctcttgctgcgtctgctaatgctttgatttttccctgatatataaagccacctctatcaaagacaacttctttgattcctgcttcaactgctttcttaccgattacagttcctaaatatgctgctgcatcaacgttattggttttttctaattctgcttttacttctttctgagtagtagaagcggaaaccagagtttttccaatggtatcgtcaataatctgagcatacatatgattattgctgcggaaaactgctaaacgcggagttgtagctgtaccgctcagatgattacgtaatcttctatgcttttttgcgcgaactttcgctcttgatactttactaaccatttttgcactctccttaattatttcttaccagttttaccaactttacgtctgataacttcatcagcatatttaatacctttacctttgtaaggttccggtcttctcttatctctgatttcagcagcgtactggccaactttttctttatcaatacctttaacaacgatcttgtttccatcaactgtagattcaagaccttctgggtcttccatttctaccggatgagaatatcctaaagaaagaacaagtttctttccctgtttctgtgctctgtaacctacaccgttaacttccagagctttttcatatccctggcttacaccgattaccatattctgaatcagtgttcttgttaatccgtgtaaggatttcattttctttaaatcgtttggtcttgtaacaactacctgaccatcttctaatttgattgacatttctgttggtaacgctttttcaagtgttccttttggaccttttacagtcactacattgttctcagcaattttaacttctacgcctgccggaactgctactggatgtcttccgatacgtgacattcttaatttcctccttacttaaattttcggaaaggcctattatggttcctctctgttttcagtacttcttcgtctgctgtacttagcttagattaccaaacaaatgctaatacttcgccgcctacatgcagttttcttgcttctttgtctgtaataacgccctggtttgtagacagaatagcaatacccagtccacccagaactctaggaatttcctggcttcctgcatatacacgaagacctggtttagaaattctcttaagacctgtgataattttttcgttcttgtctgcaccgtatttcagtgtgatatggattgttttgaatactccatcttcaagaacttcgtattttgtaatatatccttcttttaaaaggatttctgcgatagcaagtttcattttagatgccggaacatctactgtgtcatgttttgcagtgtttgcattacgaattctagtaagcatatctgcgattggatcgctcattgtcatgatagtttcctcctataatttagacttttcatgtgaaattaataatttatattgtaacgacccggcactaagtgaagtctgccgtaaggcgaagacttctcttaagtggcttatggtcacttacttacattttcggcttaccaggaagcttttttaactcccgggatctgacctttgtatgctaattcacggaaacaaattctgcagattccgtattttcttaaataagcatgtggacgtccacagattctgcaacgattgtattctcttgtagagaatttctgtttacgctgctgttttactttcattgctgttttagccatgaattttccctcctataattattttgcgaatggcatgttaaataatgtcaataattcacgggcttcttcgtctgtctttgcagttgtaacgaaaataatatccatacctcttactttatcgactttatcatattccacttccgggaaaattaactgctctttgattccgagtgcgtagttacctcttccatcgaatgcgttaggattaacgccgcggaagtcacgtactcgtggcagtgctaagttaataaggcggtctgcaaattcatacatcttttcgcctcttaaggttactttacaaccaatcggcataccttcacgaattttgaagtttgcgattgaatttttagcctttgttgtaacagctttctgacctgtgattaattccatatcagctacagctgcgtctaacagtttagcgttatctttggcttcacctacacccatgttaacaacgattttgtcgagtttcggcacttccatgatattcttataaccaaactttttgatcatagcatctacgatctcatttttgtatgtttctttcagtctgctcactttaaatggcctcctctcttattaatcgattactttgcctgtagttttggcgaaacgtacttttttgtcaccttccattttgaagccaacacgagttgctttgccttcatgcataaccattacgttagatgcatcaagccatgcttctttctctacaataccgccctgctgatttgccatggatggttttgtgtgttttgtgaccatatttacgccttctaccagaacagcaccttttttcggattaacagagattacttttccttctttgtctttatctttaccagcgataactttaacagtatcaccttttttaattttaaatgttgacatcaggtacctcctataatacttccggagctaaggaaacaattttcataaactgtttatcacgaagctctctagctactggtccaaaaatacgagttccttttggtgttttatcatctttgatgattacagcagcgttttcatcgaacttgatgtaagaaccgtctttacgacgaactccttttacagtacgaactacaacagctttaactacatcaccttttttaacaacgccacctggtgttgcatctttaacagtagcaacgattacatcaccgatgttcgcatatcttcttgtagaaccacccataacacggatgcagaggatttcttttgcacctgtattgtcagcgactctaagtctactttcctgttgaatcatgcttagattcctccttacgaattatttagctctttctactacttcaacaagtctccatctcttatctttagagagcggtcttgtttccataacttttacagtatcaccgatatgacatgtgttttcttcatcatgtgctttcagtttatatgttctcttcacgatttttttgtaaagaggatgttttacatggtcttcgatagctacaacgatagttttatccatcttatcgcttactactttaccaacacgtgtttttctaagatttctttccacgattatgcctccttaattattcgctgtgtttgccttctgagcaatcagtgtctgaattctggcaatatttctgcgaacctctttgattctgcttgtattgtctaattgattggttgcattctgaaatctcaaattaaagagttcctttttagcagctactaattcttcctgtaattctgcagctgattttgtctttaaatcttctacataatttttaattttcactgttatcaccgccttctaagtctgcacgagaaacgattttacatttacatggtaacttgtgcatagcaagacgcaatgcttcgcgagctgtttcttccggaacgcctgcgatttcgaacattactctgcctggctttacaactgctacccagtattctaaggcacctttaccggaacccatacgtgtttctgctggttttgctgttacaggtttatctgggaaaattttaatccaaactttaccaccacgtttgatataacgtgtcatagcaacacgggctgcttcgatctggttggaacgaatccagcatggttctgtagaaaccaaaccgaattcaccgtaattgattttatttcctctagttgcttttcctctcatggtaccgcggaattgtttacgacgttttactctttttggcattaacataattatttatcgctcccttccttagttcctttagttggaagtacttcgccattgtagatccatgctttaacaccaactttaccataagttgtgtcagcttcggcgaaaccgtaatcgatatctgctcttaatgtctgaagcgggatgtttccttcgctgtagaactctgtacgagccatatcagcaccaccaagacgtccggatacggatgttttgataccttttgctcctgctttcattgttctggacattgtagatttcattgcacgacggaaagaaatacgattctctaactgaagtgcgatgttttcagctactaactgagcatctttatctggtctttttacttctttaatgtctacaattaattttttatctgtgtatttctgtaattcagctttcactttttcgatttctgaaccgcctttaccgattacaacacccggtttagcagtatagataatcactttaactctgtcagatgctctttcgatttcgattttagaaacacctgcgctgtataatttctttttcaggaaagttctgatgttgtagtcttcaactaagttatcagcgaaatctccttcagcgtaccatttggaatcccaatctttgataacgccgactctcagtccatgtgggttaactttctgtcccatgatagtcctccttatctctcatccaacacaacggtaatatggcagtttctcttttcgattctgtatgctctaccctgtgctcttggtttgattctcttcatggtcggtgctttgttagcgtagcactctgcaacataaaggttctctgggttcattccattattgttttcagcattagcaacagctgattccagtaattttttgattacgctggaagcgtatcttgggttgtatgttaagataccaagtgcagtctgaacatcttttccacggattacatccagtacatagcaagctttctgtacggacattctagcgtaggataattttgcagacggtcttgtatctttattagcatttcttgctcttttgatctgacttctatgtcctttagccatgataaaagcctccttctaaaatattagcgaacacctgattttttctcgtctttgccgtgtcctctgtatgttctggttgcaacaaactctccgagtttatgtccaaccatatcttctgtaacatataccggcacatgttttcttccgtcatggacagcaattgtgtgtccaacgaatgaagggaagattgtagaacgacgtgaccaggtcttaataactgttttatctccagcagcattcatagcatctacttttttcagtaagctttcatctgcgaaaggtcctttttttaatgaacgagccattagtcttacctccttattttgctaatgttttaccatctcttcttcttacaatatacttgttagactgtttgtttttctttcttgtcttcaagccaagagccggtttaccccatggagtacatggacctggacggccgataccggtcttaccttcaccaccaccatgtggatggtcattcgggttcattacagaaccacgaactgtaggtctgatacccatgtgacgtttacgtcctgctttaccaatgttgataaggctgtgctcgccatttcctactacaccaatagtagcacggcagttaatcggaaccattctcatttcgcctgatggcagacgaagtgtagcgtatttaccttctttagccattaactgtgcaccgttaccagcggaacgaactaactgtccaccttttccggcgtacatttcaatattgtgaaccattgtaccaactgggatttcagaaagcggcaggcagttaccaacacggatttcagcgtttgctccgttcataactttcataccaactttaagtccttctggtgcaaggatatatgctttttcaccgtcagcgtagcagattaatgcgatgtttgctgttctgttcggatcgtattcgattgttttaactgttgccggaacatcatctttctttctcttgaaatcgatgattctgtattttcttctgcttccgccaccgcggtgtcttactgtgattttaccctgattattacgtccagcgtttttatttaaggacactaccagagacttctcaggtgttgatgttgtgatttctgtgaaatcagaacctgtcatatgtcttctggaaggtgtatatgggttataagatttaattcccattactgtctctcctttcattgtaacgccgtaagcgttgtgtaccaacgcatcctggcgtttgttgcctgcagttaaatattggattactttttcttaactgcacttttcatattttcagtcaaactcttaatcttataaaccttcaaagatttcaatatctttgctgtcttctgtaagagttacaatagcttttttagttttagctgttttaccaaatgtcataccacgtctttttgttttaccatcaagattcatagtatttacatttttaacttttgttccttcgaacattttttctacagcttctttaatcatggatttgtttgcttctgtatgaacaaggaaagtatatttcttttcgcccatagcagccatgctcttttctgtaacgattggtttcagaattacatcataatactgtacgtttgccattatgcgtatacctcctcaattgaagctacagcagattttgtcaggattaaagtgttgtatttcaggatatcaaatacgttgattgtatttgtgtatgctgttacaacatccggaatatttcttgtagataaaactacgtttttgttctcttcgttaagaactactaatgctttagaaacattcaggttatttaatactgtctgcattgcttttgtttttgcttcgtctaatgttaaatcttcaagaacgattaatttgttttcctgtactctgcttgttaaagcggatttcagagccagtcttctttcttttttgttcattttaatgctgtaatctctcggtactggagcgaatacaacaccaccgcctgtccactgcggagatcttgttgaaccctgtcttgcatgacctgttcctttctgtctccacggttttcttccaccgccactaacttcagagcgtgttttagctttctgagttccctgacgattatttgcaagctgacgaacaacagctaagtgcactaaatggtcgttgatttcaacgccaaacactgcatcgtttaattccattgttccaacttctttgccttccatattataaacagatacgtttgccatctgtgtgttcctcctttccaacgaaaactttatttaacagtcttaactgtttctttgattgttactaaggatttcttaggtcccggtacagagccttttacaagaatcagattgttttctgcatctacgcttacaacttcaagattctgaactgttactttaacatgtcccatctgtcctggcatttttttgcctttgaatactttacttgggtcagatgcagcaccgttagaacctgcatgacgatggtatttagaaccgtgagccataggtcctctggactgtccatgtcttttgattgcgccctggaaacctttacctttgctgattgcagttgcgtcaactttgtctcctgctgcaaaaacatcgcatttgatttcctgtccgagtgccatttcttcagcaccttccagtttgaattctcttacgaatcttttgtaggaaacaccagctttatcaaagtgtcctttaaccggtttgttaacaagtttttctctcttgtcagcgaaaccaacctgtactgcactgtaaccatcattgtcctgtgttttaacctgtgttactacacatggaccagcctgcaatacagttactggagttaaaactccgtcttcgttgaagatttgagtcattccgactttagtagctaaaattgctttcttcattgtttacctcctgtgattctacagcggattacactgtgttgtgcaatcatcctagacagaaagttaatatatttatatcaaccttgtaaggataatttctcattaaaaattatttctgtttcatcttgatatcgatggaaacacctgccggcatctctaaacgagacagggcatcaactgttttctgtgttggtgtgatgatatcaatcagtcttttatgagttctctgctcaaactgttctctggaatctttgtatttgtgtaccgcacgtaagattgttactacttcttttttagtaggaagcggaaccggtccactcacagttgctccattctttttaacagtttcgataattttgcttgcagacgcatctactaactgatggtcataagcttttaaaacgattctcattacttgacttgccataaaaaaagtctcctccttttcgcactttataagtagtacgacaagcggcgactgtacacattcccgtgtgtgtcatctcatttttacacacactcccacatacccgtggtaagtcttcaagattttgtacagtgacttgtcgtcagtttcctaacatgacattcgctccacggaaaacctgccttttcggcagcaacctcgcgcttcatagctatcaatgtcacagcaagaatgagtatacacgattcttcaaaataatgcaagagttttttttaatttttttatttttttttgaacacaagaaaaggttcctatgacaaagtgtttctacgcaacaaaaaaagagagtcgaaactctctttcttcgctcctatgcttcttatatacagttctatatatatagaaacattttagaataaattcgtataatccaaaagcgtcaccttattatctgaatcctcaatcacttccggatggtctccatgcgcctgtgcatttcttaagaggtcttctaccgatggactcggaagaacttcttctactacctcttctgcttttggttcttcttctgattctgaagtttcttcaccatgaacagcttctgattcttcagagttcatcttaacaatccccgcattcagtgcttcttcaatttttgcttcaagcccaatggtatcttcattttcttctggttttatttcttctgtctttggttcctctgtaggaaccaaaacttcaccggcagactcttcttgtgttccctctacctgctctgccactgtttctttttccgctgtttcttccacagcaggctcttctactgtttctcctgttcttaacagttctgactttaacaattctggttttaacacctgtgtcttttcgccggcaatttctttttcatctgccggcactactgttccctctttactcatctccactgcatcctgtaaatatgaattttcatctgactttggattctgctcgaactctgtctggatgttctctgttttttgaacagattcatactctttggcagtttccggctgtgcctcttcctgcttctcatttgtcggctcttcggaacgtttcgattcaagcggaatcactttttcttctgtgttcttttcttcactttctgattttgtttcttccatatcttttttatcttttctccacaattcggcaagaataaataaaataattaaaaagacaattccaagaccaatcaaaatcaatccttctttactttgaactgcaatcgctgcataagcaataagtggaacaacaaaagacagcttcataacatctccgctaagctctacactgcgttcttctgtctttttatcataagcatctttcaccagatacgtgtcattttctgcatccgatacatctgaaatctcataaacataagcctgattattttttgtataaacaatcttctgtcctttcttcagatttaccgcatccgtctgcttaccataagcaacagaaccgaccggaagatttgtctccgccgtactgttatcattcataaccgtctttactcctacaagaggaggtactaacaaagccgctgctataaggatggtacagatgataaccaggtccacaataagttttaaaaattttgacatctctgtttcctcatttcgcaattctttcatttcttatcttaacattttctgacaaagatgtacacaaaaactttaattgatattcaaactgatattctaatcagatatccgaaatgaatattctacagattcgtcagaaatgcctgatatcccttatatgcttcataaatatccactttacttgcaatttcccacggagcatgcatatttaatacggcaactccactgtcaattacatccatatcgtatgctgcaagaatataggcgatagttccgccgcctccaacatctacttttccaagttctgcggtctggaaagaaacattttgctcgtccatcacacgacgcaatcttgcaatgtattccggatttgcatcattagaaccgctctttcctcttgagccggtatatttattaaaggttaatccgtgacctaaaaatgcacagttattcttttccatcacttccggataatttgggtcaaatccggcgctgacatcagaagaaagcatgcaggaattttttaatgctctgcgcacaagcagttcactgtaagttccacacgcattcatcacttccgccaccgtattttcaaagaatctggaatgcataccggttgctcctacacttccaatttcctctttatctaccaacaaacatacagaagtatattctgcctctgtaactgcctcaatcgctttataagacggataagcacatactctgtcatcctgcccataagccataatcatacttctgtctaatccaaagtctcttgcttctccggccggaacaacttctaattcagcggatacaaaatctttttcttcaattccatatttttcttttaatatagaaagaatattttcttttacgccttcggtctcctctccctctaacggaatacttccaaccagtacgttcaaattttctccctcaataacttctgtcgcttttttctgcatctgttttgcagaaagatgaatcaataaatccgaaattccgacaacagggtcatctttggattctccgattaccacatttacttttgttccatcttctttcaccactacaccatgaagtgccattggaagtgtcacccactgatattttttcacaccgccataatagtgtgtatcaagcagtgcctgttctgcttcttcgtacaacggattctgctttaaatccaaacgtggagaatcgatatgtgctccaaggatacgcattccttcctgaattggtttttctccaattacaaaaagagccagtgcctttcccatattgttggcgtacaccttatcccctttttttaaagtttctcctttttcaataacagtatcaagatttttaaaaccggctttttttgcctgttttataatttcatctgtacattctctttctgttttgcataaagacataaattctttatagccctcgcagaaatcaaagactggtttcttatctgcatattttttccaagcattttctgttttcattctcttcacctcaatcattttattcttcctacagcttactacaccttcatttgaattgcaacctgccaagattgactttttacccagtttctatcataataagttcaagtcgaacgcatgtgagacttggcgcgtgatttttgtggaacatttatcttaaccagagaataagtttccgacggagataccgttattttgtacgaaaggattttgccttatgaagatgaaaataaagaccatagaagacctctctttaaatgcctggccttctcataaaattttaatttacgacggatggattatccgcttttcctgtttttatacccaccgcacaaactgtgtggagcaaatcggctcttcacagattgcgctctctgataagattgcctattgcgaagaagtctatgaaaaatggaatacacctgctattttcaaaattaatcctttaatggacagttcctttgaccagaaactaatggaacgaggctatcatattgcacataccacggaagtcatgacaatgagcttggaatcttatgaaccaaaagaaccacttgccgaggtttcccttactccacatattacctctgactggttaaatgctctttttgaaatgaacggtacaaccaatccgattcacaaaaaaattgttccttccatgtatcatgcgatcccaggagataccatttttgccactgtctatgacggtgataacgtcattggaacaggtcttggaattttagaccgtgattatgtcggcatctacgcgattcatgtcgctcccggttaccgcagaagaaaaatcggtcagtctatctgccgtgcacttcttaaaagtgcgagagaacaaggcgcctgttatgcctaccttcaggttgtaaaaggcaattttggtgctcgtactttatatgaatcacttggttttgaatatctttacacttactggttccgccagcagttttaaattttaaaaaataaaaaaggaactccgcagagctccttttttattttttgctatttattcaatctttttatctgtagaacaggcttccaagctgtaaatctctcttgaaatctctgattcttgtttctccatcgatataaacagcttcaattcccattgctgctgcccagtctcccatctgttctgctgtgatatcataagagaatgcggtatgatgtgctccacctgctaaaatccatgcttctgcacctgtagctaaatctggttttggtgtccagaatgcggttgcaaccggaagtttcggcattggtttttctgttttcttgcagtctacttcgttgataatcagacggaaacgatttccaaggtcaattaaagaagttgcaattgccgaacctgtcttagatgtaaatactaaacgtgcagggtcttctctgtcacccatagttaacggatttactttgatgctgattggaccatcagaaatagtcgggcaaacctctaacatgtgcgcttccaagataccttcttttcccggtactaaattataagtataatcttccataaaggaagttccttttgcatctttcattccggcagtcatgattttcatcaggcgaaccatagcagctgttttccagtcaccttctccaccgaatccataacctttttccatcaatctctgaatagcaagacccggaagttgttttaaggagcctaaatctccaaaatgagtaacgattgcctgatagtttttctcctctaagaaacgttcaaacccgatttcaatctgagcctgcgcagctacatgtttcttaaattcttccgggtctcttccctctaagagaatgtcgtatttgctgtagtattcttctactaaagcatctgtatcagctttggatactgctgaaactgcttctgcaatctcattaaccggatatgcatcaatttcccagccaaatttaatctgagcttctactttatcgccttctgttacagctacgtttctcatgttatctgcgattctcataacacggatatggctgctttccatgataccaattgctgtacgcatccaggaagcaattctttcctgaacttttttgtcgctccaatgtccaacgataacttttctttcaattcccatacggcttacgatatgaccatattctctgtctccgtgagcagactgattttcgttcatgaagtccatatcgatggtatcataaggaatttcctgattaaactgtgtatgcagatgaagcagcggctttctgtattcctgaagacctaaaatccaggattttgccggtgagaaggtatgcatccatgtgataacacctgcacattcttcatcttcatttgcttcattgaaagttcttctgattacttcgtttgtaattaaagttggttttaatacaacttcataaggaagtactcctgatttatttaattcttctacgataattctggaatgttctgcaacttttctcaagcactcatctccgtataaatcctgtgagcctgttgcaaaccaaaacttataattttttgatgctttcattttaaaaaaatctcctttcaccgttacgattttctctcatggtttttctaattcccatgatacagcttgtatggtcatctttacaagttgtatcacaagaaaacagacaagtttttcttgtgcacatacaagttctatttatacaaaaagaagaaagagtagacaaacaaaactgtttatccactctttcttcttttctttttcgttttcttcctgtatttcttttccgtcaaatattactctttaaaacaaaagcaattacttccgatttgataaataagcctcgatactcttcatcgcttcttcttcatcttcaccttctacagatactgttacactttctccagcatctaatccaagactcatcattcccataatactcttggcatttactttctttgcttcactctccagataaatattgctggaatactgacttgccacctgaactaacatagcgattggtctagcctctaacccatttgaaatgccgattgtaattggttttctgatcatacttgttcctccttacttcccctaagttcttctgctatcctgccaattttacgcaatctgtgattgactcctgactttcctactcttggatttaaccgttctcctaattcttttagggaagcatcctgatatttcaatcgaagttccgcaactgcttttagattgtccggcagtgtctgaagtcctaccgtattctggatatacctgatatcctgtgtctgctttaccgatgccgacaccgtcttgttaatatttgccgcttcgcagtttacctttcggtttacactgtttcgcatttccttaaggattctgacattttccagattcataagtgatacgcctgctcccatgattccaagaagctctactatctgtgctccctcttttacataaaccacttcgtgcctttttcgactcactgtcttagcctctacttcaaagctgtgaagcgtttcctgaagctgttctgcctttatcgaacttgtacagacaatttcaaagtggtaaaacttttccggatcactgattgatcctgcacataaaaacgcacctcttaaaaaagctcttttacaacaatttttctggattatcaacggatttaccagaccattaaatgtaatcggcattctgtcctgtgacagatacttcatagcctgcaaaatccgaatcgcctcatcctcacctggaatgtccactacatacttattatttttcctgtataagacatcccctattgaaaacactttacttattctaaatgttttttccaataaagtaaagtactttcttgcaacactttcgttttctgctaaaaaatgtaatgacagtctcttttctgctccatattttatctccccgccaaatgcaaacatcgccgcaagttctgctatctggcaatgccttgcagggctgataattccctccagttcttcttttacactcgccgaaaacgtcatctctttgcatccttttcaatgtctctatgctcaatccgaacaccatattccccatttttattcagtctgttatataattcattggcaagagttacacttctatgttttcctcctgtacatccaattccaatcaccagctgactttttccctcggaaatataatttggaattaaaaaccgcatcatatcttccagcttgtctgaaaatatgtgtgctaattcagacctcatcacataatcccgaaccgacgggttatttccggtctgaggacgaagttcctctatgtagtacggattcggaaggaaacgaacatcgaatactaaatctgcatcttccggaattccgtatttaaatccaaacgacaagaccgtaataatcatattttggaatgattgattatctacaaaaatcttttccagttccgcctttaattcccttgtcaaaagctggcttgtatccaaaatataatctgccgattttcttaaaaattttaaatattctctctcttttcgaattccctcatctactcttcccttaccggacagtggatgagagcgccgtgtttctttatatctttttaccagagttttatcatctgcatctaaaaataaaatttcaggttcaaatcccggaactctaaggcgttccagtgcctgctccagttccccaaatgccatcccgctgcggatatccactccaagtgccactttattaatgtctcctgaacctccgtcacgcaccagttgtgcaaatttatccaaaagcggaaccggaagattatccacacagaaatattccatatcttcaagcatctttaatgctgtactttttccggccccggacattcccgttacaattacaaaacgcatctttaaaactctcccaaaaattttatctcagtctccagtaaaataccgaactcatcctgtacttttttctgcactgctttcaccagatttaaaacatcctcagctgttgctccgcctgcatttactacaaaaccacagtgtttttcagaaacctgtgcaccaccgacctgaaaccctctcaagccggcatccataatcagttttcctgcaaaatgtccctccggacgtttgaaagtgcttcctgcgctcggtctgtccaacggctgtttgctgactcttttttcttttaaatcatccataactgccttaattgaatccgcactgcctttctttaactcaataactgcctctaatacaatataatttttctcttttacaatactgtggcggtatcccagctctaattcttcatttttgagtgttcttacatttccctctgtatcaaggacagttgcctctaccagcacatctttcagctctccgccataagcacctgcattcatgacaactgctccgccaagcgttcccggaattcctgctgcaaattcaaatccttccagagactgttcaagcgcacaggatgcaattttagaaagctgtgcccccgcctgtgcacgaatttttgtttcatcttctaccgatactttactcatatttttccaaatctgaatgactgccccgcggtaacctttatcactgacaaggagattgcttccatttcccagaataaaatacggtgtccctgtctccttacagacatgtattactgcttttaattcttccgctgtctgcggacataaaaaataatctgccggtcctccgattcgaaacgtagtatgtttttccatcggttcttctaacttaacattctcaattccaatacaatcaattaatttattttcaatttctttcttcacttttttacctcttaacttatattatgatgtactacagaaaagttccgaacgtacatgactcattctgtcaggtctgaaatcacctgcgctgctatcataaaccccgcaattccggaagaaaaagaaatactgttcacctgtgtacctacactggtctggtcttctttcaaaacagaacgtttctttttggaaaactcctgtgtagaataaaaaacttttatattttttgctttttgaatctttaattcctggcgaatttttctcataaacggaagattcaccgtcttagaaaaatctgctatgcgaaaacaggaaggattccacgcatttccaattcccatacaggtaattatcggcgtatgaaactttctcatctgctttaacaacaacaattttgccggaacatgatccattgcatctacaacataatcataagaggaaaaatcaaataaatcaatcgtgtcctctcctaaaaaagtttcataagtatggacaatcgcattctcattaatatccatgatgcgcactttttccacctgcacttttttctttcctattgtagaacgcagtgccacaatctgacgattcagtttcttcgctgacacctcaccataatctaccaatattaacgtccccactcctgctcttgccagcgcttcaactgcataagaacccactgttccaataccaaataccgccaccttaagctgatccggactctttcttttttctgttcctgataatccttccgtacgggagaatacgtggagcatacgtttccttcctcctaatgtttctatgaaatataaggatgccaaaatttccaagctcaattccaacatcattacgtttcattatactattaattttggaagttgtatagaactactttttcatctttggtttaaaaatcaggctcgcaagatagccaaaaatcagcgctgccgaaatccctacggcacttgattcaaaaccaccctgaaaaatgccaagcagtccctgctcatctaccgcctttttgattcctttccacaaagtatttccaaatccaagcagaggaacactcgcccctgctcctgcaaaatcaatcaatttctcataaattccaagtgcaccaagcaccgttccggtacagaccaacagcaccataactcttccgggcagaagtttcgtccggtcaagcagaatctgcaccagtgcacaaatcagtccgcccacccagaatgcattcagataatccataagttcgccctccacattgcgtattgcacatcttttttgcattgccaaatctattttaacaatgttcgattacaactgcctgggcaatcccaggcacactttttccctcattataacttactttagataacagtgctccagtcggtacaaacagcacccgcttccattcacctttttcaattttgggcagaatatacgaagcaaatgtcgtggcagaacatccgcatccacttcctcctgcatgggtgtcctgtgtttctttatcataaatttcgattccacagtccatcagctttgccgtaacatcatatcccttttctttcaataaatcaatcaaaatttcttttcccacttctcccaaatcaccggtaataatgcggtcgtagtcctccggttttcgtccaaaatcctccagattctgataaatggtatcgctcgcagccggtgccatacaggctcccatattcaaagaatcctttaagccgtaatctatgattttccctgttgtaattccggtaattcttgcttttccgccttttcggccaagcacacaggctccgcttcctgtcacagtccaggtagctgaaaacggtctttgatttccatatccaagtggaaatcgaaattctttttctgcacttccaaaatgacttgaagttactgccacaacataatctccatatcctcccgccaccgccatagaagcaagcgacagtgcttctcccattgtcgcacaagctccatacaatccataaaccggaatttcaaatccaataatcccaaaggaagaggcaatcgtctgtgccagcaggtctccggcataaatcatacggatttcttccttggagagtcccactttttttatcgccatcgatactgcttctttttgcaggatactttcggcttcctcccacgactggcatccaaacagcccgtcctcttctcctattttgtcaaaatattttccaagcggcccatctccctctttttttccaaccatagaggctccacttaaaatatgcactgcattatgaaataaaatactctgttttcctatcatctgttcccgttccatttttatccagacctccttatacgattccacattgtctaagcgtataataaatcagccccatcagtgctgaagtcaaaattccatacagaatcaccggccctgcaatgataaaaattttacacccaatgccgaatacctgtccttctttttgatattcaattgccggtgccgctactgaattcgcaaaccctgtaatcggtactaacgtgcctgctcctccccattttgcaagtcttggataaatattaaatcctgtaagaatgacactaaaaagaaccaggaggagcgaagtccagcttccactggtctgcgcatcaagcccctggctcttacaaatattcataattccctgtcctatcgtacagataatcccacctgataaaaaagcacgcgccatatttttcggcaaactgtgaacaggtgtcattttttttacgtactttccgtattcttcttgttgttttattttttcaattgcttctgctgtggtttgagtgttcttagccataccagtcaccatcctcttctatattcttgaaatttttctacagctcatttcaaaaatatatctttttactttaggattagtatggcttttcaaaggcaaaattattacttctccgcttctttttcttctccgtacaaccgttttgccctcttcaaacaatgataccggtctatcgacatcacaagtcccatttcagccataataataacgatagaagtacctccatagctaaaaaatgggagcggaatacctgtatttggaaataaattaatatttactgcaatgttaataatactctgaactccaatgtggaaaaagactcccatcgccagtacagaaccgtagacattttcagaattctttgccacctgataaatcaggtacaacagataaatcaaaagtccgataataactaatgcgcccaccagtccaagttcctcacagataattgaaaaaatcatatctgtatgagcttccggaataaatcccggcttcttttgtaccgaattaccaaatccctttccaaaaatcccaccggaaccaatcgcatacaaagattgaagcgtctgatacgattttgtcgaagcatatttctgtggtgcaagccatgcagcaattctcgccttacggaacgaatatgtatccgcattaatcaatgtttcacttggcagattaaagtaaatcgaaagcaccattgcaagactgacggctattacacagacaagtgcaactatttttaatttcggtgatttaatgcagaccaccgtgattaggtaagtaatcccaagtacaacaattgcagaactcaaatccctcgacaactgccacaacatcaccgccggaactgccccgactccccacaataaaaccacaaaataagaattattttttataattgtcggtctaatccagtcagctgcctgaataacctttgccgaccgcttctcaaaaatcttgtgtcttggcttcatataaacataccgtctttgaatcagacaggccaatgccaggatcacaaatacttttaccggctcagccacctgaaaggaaatcggtcctaactgaaaccagcgcttcgcaccgtttatctcttctccttttgcaaacacccataaaatcaatccaattccaacaagataccccactgtcgtaaaatgccagaatcctgtataattcaatttcggcaaaattaccatgcagactaatccaagcaaaataaataccatctgccgtttaaaatagtagaaagaatcataattatacttttctgaattcgcacaggtcgtactcgacgcagaataaatcataattgcaccaaaaaagcacaaaataagcgtcactgcccaaatttgaaactctcttctctttaccattgaaagatacttttcttttatctgcttatttcgttttttattttcttttttccggtttttctctcttattttatctctttggctttgattttgtttctttgagcccttttttttctcactttttacagccatcttttctctccccatgaatcgctaactttaatagattaacacaccggcagtttatttgtctatgtttatccgtaaaatcggtcaattcgttttatgagaaagtctggctttttcattttgattttgctcgttataaccctcaaagccctcttcaatttcttttaaaatctctgcataacgaagcagttctctttgaatttcttctttattatcacgctcctgtttataacagattcgatgctccatgcttgcccagaaatccatgccaatggtgcgaatctgcacttccaccggataatattctgtactttccatcgaatatacctgaatccccagaatcatgtgaaaactgcggtatccatttggttttggatttgtaatatagtctttttctttgactaaaatcaaatcactctgttttcttaactgttctgcaaggagttcgacatccttttcaaagtagcagataacacggattccggcaatgtcctgcaaatgctcttttgcattcataaaactcccctgcaaatccatgcgttttaatttttcttcgatacttgctttttgtttaatacgaaactgtatattatgaatcggatgtgatttattgccatacatggaatgattgagtacatcaagtctggcttttaaaagattcaatgcatcctgatacggcacaatcaagtcgtagtattgttcatttgtcataaaactttctttcctccggtcttaaaaacttacagcagtccgcccattctgctgccatgggttattataccatattcaatgccggtggaaaataaatcttccatgaaatttctatgaaactcttatagattttttatcctgtaaaatgcttctcctgatttccccagactcactatccttttcttaatctttaacaaaaaaactgaaccagacttccaagtacctttccaactgcaagcgataaaataaccagtcctgcacctttcgtaagaccgactcttcttgccataattgcaaatacattcacgacttctccaagcgcaatcacccagcttcccagaaaaatcccaaatccgattccaacaagagctacgcaccagatacccagattgatatgaatccgataaagtaaaaacagatttcccagaaaactgccaagcatcaggctgttttcataaaacagtaaatgatttccggtgtgtgtcactccggcatatctcggaatcattccaagtccgataataaatgccgccagagctgttgctacaaccataccgccacataatcccacaattccggccaaaagctctcttaacatcttattttcgttcctttcttttttcctgctcaatcagtgtcttattgacatcatcctcataaacccgcatttctacttccattggagtcgggtcttccgtaatctttctgccaccaaaatgattaaagaaaaagacaacaccgagtccgattccaattgaatacgatagttccaaaattgtttttccatttgaaactcttccggtgatctgctcatatactttcataaataaacctgccgtatcaacatccgtattgaaggtcataatcgaaaatgcccctccaaaaaatgtcacaagcgatacaaaaattgtttttaaccaggaatagaattgatgggcgtgtttctgtgtttcataagtcagaataaaatttgcctctccgatatgcgtcacatctacgctctcttcatttctttgaattaaatccacgatttccagtgcagatattacataccgccctggtttttcatttggaatcgtaaataatttgcgggctttatttcggtttaatacttttccattactgcatgacaaacttgccacatcctgaacgtaaacttcgggactgtgtacttctacatttttttcggtctgtatatataaaatatcactcatgttttctgctgctccttgccttataagatgcagaatttagtatttaacaaacgtctgaaaattatacctgaattactctggattactcctaatcaatccgttcccttaaaacttttaaaatctttttctccattctggaaacctgaacctgcgaaattccaagttctcctgcaatctgcatctgtgttttttcctgaaaaaaccgcagataaatcaattcccgctcttttgcctccagacttcccaaaagctgttcgagaagcattttatttaaaagactctcctgtccgttttccggttcttcgattttatcttccagtacaattccacttccatccccctgataaatcatcttctgcagggattcaatctgtgcacctgcctccattgccatcacgagttcttctctcgtcaccgcaattttctctgcaatctcctcaagccctggttctcttcctctttcggcaaatagtgcctcatgtacccgataagcctttgcattaatctcttttaaagaacggctgacctttatcattccctgatcccttaagtaacgcttgatttctccggttatcatcggaactgcataggtagaaaatttcacatcaaacgaacagtcaaatttatcaatggcttttaatagcccaatcgttccgatttgaaataaatcctccatctccactccacgatttaaaaatcgttttacgatactatgcaccagacccgtatttttctctaccagcgtatctcttgcttccttatccccttggtgtgcacgcccgataagggcaaggacctcatccatagcgcctccttattcttcaaagctttccctgcttatgccaattttctttctcatacgcacggttgttccttttcccacctcggattcaaccaaaagctcgtccataaatgcttccataaatgcaaatcccataccggaacgttcctggtccggtcttgtcgtaaacattggctccattgcctgttttatatcttcaattccctttccataatcaattatcgtaacaaacaactctcttttacctgtcttacattcaatcctgattttctcctgcttcttgttatcataagcatgaataatgcagtttgtaatcgcttctgatacggcggttttaatatctgcgacttcttctaatgtcggatttaactgcgttgcaaatgctgcaacggtcactcttgccagactttcattacaagaacggctgacaatttctaatgtcatttcattcgtatactccatttttatgctcccccttatctttttttctgatgccagactgtttcctgactgatttcaatatatttataaattccggaaatccgcataatccgatatacacggtcattcacatgaattgccgtcactcttcccccactataacgcacaatccgataccgtcccatcaacattccaattcccgaactgtccataaatgtcgtctttgaaaaatcaaataccagttgggaaatctcccctttttccagctcttcatccactaccttggtaatctgctgtgcaaaatgatggtccagctcttccggcacataaaccatcagacaattttcccttcgtttgattacatcactcatactgattaccccttactctattctttcaatcttttgtaaaaaaaggatgaatactcatcgtatccatcctttttctcaaggtttctcttttgatttttctattcttctgaatcttcttcactataatcagaataactgttatcctcttcatccgagttgctgtaatcttcatcattattatcattagaggtatcttcttcatcattattatcataattcgaatcatcctcttctgaattatcttcttcatcataatttgtatcgtccgaattatccgaggtatctgcctgactttgcgtctgactggattgtgaagaaccagaagaagaacttccccctgtcaatgcatctaaataatcctgcgcatcggatgcattctgtgttccagggaaggtatcaataatcttctgataccaggtctttgcattgtctgtatccccactcttctgataagcctgtgccagatagaacatcgaagtaaagtccggttctccgatatcaagcgcttttgtataattttcaatagcagttgcataatcaccgctctcataagcatccatcgccgtactttgatatttctgtttgacactggaaccaatgtctcccataatcgcatcgtacatactctttgcttcaacggaaagcaggtcactgtttactccttctaaggcatttgctgctgtctcataattttcatcattatatgcctgccatgcctttaaaagattttcatagctggttgttgtttcttttgcctgagaaatctggtctgtcgctgtatttacagattccgaagaattgtcaatttcttcctgcagacgagtcagttctgctgcctgtgtcgctactttatcgctgtattctactactttctgatttgctttttgattaatccgctgattctgtgccggaacaaccaaaaaccacaatgcggaagccccgaccaaaagcccgataatcagattgattaatgtattggtaacggtacgctcccgatattccattggttgaatgaccacgtcatttccggagcgataaacgactcttccttctttttcctgttttactttttctcttgccttaaatcttggctctaaatttgtaattttaccggtctgctgttctacttctcttaaaaaacgcagagtagtcgtattggtcttatcaatttttgccgctgatttcaactgctttcttgccttctcatattttccattgcgaatataaatcagtgccagtaaatgataacctttaatcagtttcggattgtccgcaagcacttttctaagctgcatctctgccatgtcgatactgcctcttttacagtattccagacattgattgtactttttgatactcatgttaatcgtatcaaggcggtttgcatttttctgcagacggttgatataatcagctgcgatattattttccggctgcatatttttactgattacccattcacttaatgccgcaaccacttcaccggtctcaaaataaaccagtccgagaagatttctcgcatgaatattgtatttatacattctaagacttctctgcaggcaggtaattgcccctgacaggtcacgaatctgtgctttttccaaacctctgttataatacaaattcgataatgcgacaatctgtttctgcaccgtcacattgcatccgcatccagggcaataggaagagctgttaagctgggtattgcatatcatacatttcatctatttactccctattttctggtgttcccttcagtttcttttaaaatttctttgagtatatccacaacatcagtcaaatcctgacgataaattgcattttctgcatcgtccacatcctgacacggctcaaatttttttaattcctcttcgtaattaatcatttgtttctcctttttaaatagtccttaatctctccaacgagatacaaagaacctacaacaaatagtaacccgtctcctttttttgcataagccagttcaaatgccttttcacaatccggttctgcatagacctgcttacaaccgttttctctaaacaattctgcaagttctgttgaagactgttttctgcttccccagatttctgttacatatacattggagaaatgaagtccattacagattttctgaatcatgtctttaaaatctttatcggaaaccgttgtaaaaagcagagtaattggataatcatcctggaaataccgaacggtttctacaaattttgcaattccatcttcattatgagctccatccacaatgacacctggcagtactgtttccattctgccctgccattttgtatgctccatcccggcttttaaggtttctttttcgattttatgaacttcttttaatactcccattgtttccaccgcaagagatgcattcatcatctgatattttgcaataaaaggaatgaacaagtctattgtaccataaattttagaatcgtaggtaaatgaaattccatccggtgtataagaagtcatcttctggcttgcctgttttacctcataatacggacaccctagttcttttgcccgatttttaatgactttttcggcctcttcctgatttccatcaaagataaccggaacacccggcttgataatgccggctttttcacctgcaatcttttcaatcgtatcgccaagatattccacatgatccagactgatagaggtaatcacgcaggcaagtggagatacaatcgaatttgtcgcatctaaacgtccgcccagcccggtttccagtaccagtaaatctacatctgcctcatcaaaaatgaccattcccattaaaaatagaaattcaaaataggttggatggtaatctcctgcctctacaagctcatctgcaagcgctttgatttttaagaaagcccgtaaaaatgcctcatctgaaaccatttcttcgttaatctgaaatcgttcattaatctttatcagatgcggtgaagtaaacaacccgcacttatagccgccttcttcaagcattgtggaaagaaacgcacagacactgccttttccatttgttcctgctacatgtataatttttcgttttttatccggacttcccagtaaatccagacactttctggtatgttctaatttatttttcgttgtaaatttcggaatttcttctatgtatgcaactgcttcttcgtaagtaaacaaaaattaatccttctttcttttgtcatttccctaaaaaatcaccgctccattcacaatgataagggtcacttaccattataatgaagcggtgacaatatgcaagcaaattatgtcggttgtaaactttttcttttactgtgtctcgacagtagtttctgacttctcggaagatgccccgttttccaccgcgtctgctttttcatctgtttttgtttctgtctgtccttctgtctgtccttctgtctgcgaacccatatctgtctctgttgtgtcttctgtggattcatctgtttgtgctttggatgtttcatgataaatctgtgtttctgtccgacttaatacctttcgggtagaactgttactgcggattgcgatatccacttcatctccatcctgtaaatcaccatctgtcagaagaagcgtcgtcggactgacatacgttacttccactaattctccattcacctcaagataagcagactgcgtgaagtttgtaccggtaatataatatctgccatccgaaattttttcaattttatctaaggttacttcttccactccaagatgcagcttttctttctgatatggattttttccgccatagacatactgttttccatataaaatatcatactgcagcatttccaaatctgcctgataattctttgtctgtcttcttgcctgatgataacggaacacatttccttcatgaattccaacacggttcatgacttctgctgccatctgataagcagcaatatttgcatctttcttttcaagctccatattatcccagattacatattctgtctggaacagataacgattctccatatcttctacggtcaatcccattgtcggaagatgatccccatacatgacaagcactacatcttcatcaagttgagataaggtatccgtcagttcttttacaaactggtccatctcataaatctgattacagtaatactcccatttattatttaacgcctctgtactcgaaccgcttactgtaatcttcggattttcaatcgtcggttcttccggataatctccatgtccctgtaccgaaatcgtataaatatagtccggatcatctgtctcatttaacgcctgcataatatattttgtcagatttcgatctctcatccagtcattcgggtttgtatcatcctgttccgacatatactcttccgaagtaaaggtatcaaatccaagatttgcaaatacactttttcttccataaaagttcgcctcattattatgaatggcatgagtccgatatcccagactctttaatacataaggtgcactttcacaagttgtttcttttaaaatactcttatatggatattcgccaggtccaaaataatgtaagctcattcctgtaatgctttcaaattctgtatttgctgtacctgcgcctacagaaggcactttataatatccggaagaatattccttcatcagttttctgaaatttggaatcgggtcttccgaaacatttaaataattaaccagtgtcggatcaaaaaaggattccagctgtaaaaagataatatttggtcttttttctcctgttttgggcagatttgattcactgtcctcaatttcattgattgctgattcagaataatctctcggacagctgattccggtattaaaaatcgtagttgccagacagtatggatatccataatcctgataagcaaatgcaatatttccaaagtaattggaaagcactcgtttatccagtgccagtctggttgttcctgcaaatgccagcactacaatcagcacaaacggaatattgacacggtaacgtaattttcctctgtatcttggcccttttacaaataaaataatcattgcaatcagcaccagtattgcaataatcattacaataacaaagaaaaacggattcaaatacttatttgcaatcttaactgcgtcggtaatcagatgtaaatccggtcctgtaaatggagtgacacggtttgccaaaagcacaccattaataattccaagtccaagccagaaaatagttaacaataccctcataaatactcttcttcttaccagatacactaacatagtggttgtaaaaataagaaatgagttatataaaaacactaacggtctttctgtcatatagctaaaagcttctgacacagaatgtctggagatggcctcgattacaaaatataagaccatcactccaaacatctgaagaggtactgacagaaagttcaaaattttgataaactgtttttttatggatttcaaatgctcaatctcctatcagccttgcttacttttcaagctgtttcagtctctcttttacctgttccatcatatttgtatatttttcaagttttgctttttcttctgcaaccttgctttccggagctttgcttacgaagcgttcattgcttaacattccttttacgcgggcaagctctttgtttaatttttcttcttccttgtgaagtctttctacttctttttcgatatctaccagttctgcgaacggcatatagataactgcctttgaagttacagcagaaacagcatcttcatcgattccggctttgtctgcctgtacaacaacttcacttgcataaccaagtgttccaaagaatacttttccattttcaaatgtctcacggattgcttcatcttcagaaacaacaaatacttttgctttcttgctcggcggtacattcattccggtacgcacattacgaatgcttctgactgcttctttgatgatttcaactgcttcttcatccgcttcaaaatcccatttggcttttctttccggccaggaagcaatcatgatagattcttcttccggacgaagagtgcagtagatttcttctgtaataaacggcatatatggatgtaataatttcagtgcatttccaagaactgtttttaaagtccaaagagctgctgcttttgtggtgtcttcttcattgtacaatctcggttttaccatttcgatataccagtcgcagaattcttcccagataaagtcatagactttctgaacagcaataccaagttcatatttatccatattttcggttacttcttctgccagtttgtttactttagaaagaatccatttatcggcacccgttaaagcatttaaatcaatttcctgcggtacttctgctttttccaggttcatcatgataaatctggaggcgttccatactttatttgcaaagttacggcttgcttctactctctcccagtagaatctcatatcatttccaggtgcatttcctgtcatcagagtcagacgaagtgcatccgcaccatatttatcgataacctcaagcgggtcaattccatttccgagggatttactcattttacgtccctgtgaatcacgtaccagaccatgaatcagtacatgatggaatggagtttttccggtctgttccagacctgagaataccattcggataacccagaagaaaatgatatcatatccggttaccagtacatcggtcggatagaaataatttaattcttctgtattgtccggccagccaagtgttgagaatggccataatgcagaagagaaccatgtatcaagggtatcttcatcctgtgtcagatgttcacagccacatttcgggcatacagacggcatttcccttgcaacaactgtttctccacagttatcacagtaataagccgggattctgtgtccccaccataactgacgggaaatacaccagtcacggatattttccagccagtgcatgtaaatcttatcaaaacgttccggaacgaaagtcaggttgccatcctgtaatgtcttgattgcagcctctcccatttctttcattcttacaaaccactgcggtttaatcattggttctacggttgtaccacaacgatcatgtgttcctacactgtgagaatgcggaacaacttttactaaaagaccaagctcttctaaatcttttaccattgcttttctggcttcgtaacgatccatgcctgcgtattttccacctaaatcattaatggttgcatcatcgttcatgatattgatttcttcgaggttatgacgttttccgacttcaaagtcattcgggtcatgtgccggtgtaatttttacacaacctgttccaaattctttatctacatattcatcagcgataaccggaatttctctgtctgtcaaaggcagttttaacatttttccgattaaatctttgtatctttcatcttccgggttaactgcaactgcagtatcgcccaacagagtttccggacgggtggttgcgatttcaacgaaacgaccttcttctccaacaatcggataattgatgtgccagaaaaatccatcctgatcctcatgttccacctcagcatcagaaatagaggtctggcagaccggacaccagttgatgattctggaacctttgtaaatatatcctttttcgtataaacggataaatacctctttgactgcttttgaacaaccttcatccattgtgaaacgttctctgtcccagtcagcagaagcacccagtttctttaactggttaataatttttccgccgtactcttctttccatgcccaggcatgttttaagaattcctcacgacctaaatcctctttattaatcccctgctcttttaatttttcgattacctttacttctgtagcgattgctgcatggtctgttcccggctgccacaatgcctcatatccctgcattctcttaaaacgaatcaggatatcctgcatagtttcatccagtgcatgccccatgtgaagctgtccggttacatttggcggcggcataacgatagtaaacggttttttatctctgtttacctctgcgtgaaaatatttattatcaagccatttctgatacagtctttcttcaagaccctttgggtcataagtttttgcaagttctttgctcatgactacctccttgtttttattggtttatttttttgcagacatttatcataaaaataaaaaagcctttacagataaaactgtaaagggcgaatgtccgcggtaccaccttgctttttaactctaagtctgttaacgcagacgacgcgtgaacacctacgcaggatggcttttctttacagtcccctcaccctttcagcattccggttccaaagctaccttccacttgttcctctgaaacgtgctttcagcattttgccgttctctctggcagatttccaaatgtactcctctttttcaacaccttttgctacgatacatcataatcataaaaaatctttttgtcaagcaaaaaaatgaaccggaagttccgattcattttacattcgctctttctttatttacgggggaagttttcttccccctgccgtttaatcagtcgcataattctataatgttcaggctccgagctttggcattccatacgaattccagatacaaaactttggcacggaagtttttcaccttactgctgttaagcaggtttcctggctcatggattaacgcttcgccgcccttctcatataattttatacaatgggtatctccggcgtcactccccatatacagtgaccggctcgctcaggccttgcacctgattcccttttcacctattctgtgcggtcagtatagatgcactcaacagttctatggaattatactagatttatagtaccattttctatcagattcgtcaagtttccttttacattttgcatgataactttttaaaatcattattcttcgctgtcattttttccagcatgccaccaaatgtcccggtgtcctttcttctaattccggttcctgctgcctgcacaaatccatcgcatacggacaacgtgtatgaaatcggcatccggatggaacatgaagcggacttggcagttcccctttcattccaaactgttccagactaagtgcccgctttggatccgcaattggaatggctttcagaagtgcctgtgtataaggatgacaaggattatcataaacctcatcgctttctccgctttccacaacctttcccagatacatcacaccgatccgatctgaaatatggcgtaccatagataaatcatgtgccacaaacagataagtcagtcccagttctttctgcaaatcttctaacacattgacaacctgtgcctgaatggatacatctaaagcagaaattggttcatcacaaagcagaaattccggatgaaccgataacgcccttgcaataccaatgcgctgacgctgaccaccggaaaattcatacgcatattttcccatatcgtctgccttcattcctactttttccagcaaacctacaattcgctgttccatctctttttcagaaagcttttcaaaaactgaaatcggctctgccataatttctcttacattctgatgtggatccaatgcggaataaggatcctgaaagataatctgcatccgtttatggtaggaaagaagctcttttccttttatttttgttatatcatctccatcataaattaaagtaccatccgtaggttcgtacatacgaatcagcgttcttcccaatgtggattttccgcatccggattctcccaccagaccaaatgtttcccctctctttatcgaaagactcacacgatctactgcttttacctgctgtatcgttttcccaaaaaaattttttaccggaaagtacttcgacagattctttgcttccaggagatattgttcttttatttccatagttatttctcccctttcttctcttgctcatccagttcttctttcgtaaaaatacatctggatgactgtgtttctgaataggaacgcataaggggaacttcttttttacactcctcacaggcaaatttgcatcgtgttacaaaaggacatccttctggaggatttgccaaagatggtgccatacccggaatcggttccagacgttctcggcagccactttcacatttcggaattgcatgaagcaaagctctggtataaggatgggttggattttcaaaaatttcttctgttgttccttcctccataataagtccaccatacattacttcaatccgctttgccagagaagctaccactcccaaatcatgcgtgatcaaaataatattcatatgttctgtttcatttaactgttttaaaagctgtaaaatctgtgcctgaatcgtcacatcaagggcagtcgttggttcatctgcaatcagaaggcgtggctgacagcacaaagccatagcaatcatgactcgctgtctcattccaccggaaaattcgtgaggatactgctccatacgactttcaggagaagaaattcctacctttgcaagcatatccactgctacttttcttgcctcttttttactcagcttttgatgacgacacaagacctcagtcatatggcttcctatttttttcagtggattcaaagctgtcatagggtcttgaaaaatcatagccatgtcttttccgcgcatcttttctttttctttctctgacatggataataaatccttctttaacacttccagatggtctgcctgtatctctgcattttctccaagcagtcccataacagatttcatcgttacactttttccacttccggattcccctacaattgcaaggatatccccttcatccacataaagagaaacccctcgtactgcctgaattttctgtttatgacttttaaatacagttgtcagattgtcgatggttaatactctattttcattcatcttcttatctcctatttactttcatccatcacacgcggatctacataaatccggagcagattacccagcttgttaaatgcaaatatagtcagcataattaaaagtcccggaataattgccatataaactgcattttgcagattactctgcgcactttgcaataattttccccaggatgacaaaggttcctgaattccaattcccagaaagcttaaagaagattctgtcataattgcatttgaaatacttgtcgttgctgcaataataatagtaggaagtacagatggaatcagatgtctgataaccattttaagtaaggacacacctgtaaaatctgcatataatacatattcccgctcctttacagacattacctctgcccgaacaagtcgtgcaatctccatccaggaaaagaatccaattacaataacaattgataccagtccctgtttaaaaaagatactgacaaccgtaaccaaaatcagccatggaatagattgtaaaacatctacaatacgcatcagaatactatccacgattcctccaagatatcctgccagaatcccaactgtcacaccaatcgtaatactcatcaacatagcaagaacaccaactaataaagaaatacgacctccatagattacacgagccagataatcacgtcccacttcatctgttccaaaaatatgaacactgcttggtgcctcaagcatatgagagacatctgttttatttggctctaacggcagcacgggagccagcaaagataaaatcaaaataattgcaagaaaagcaatcgaaaatattgctattttatcatgctttaatgcctcccagacattttccagacgttttttttgagaatcattcattgccatatacttacctcatctttctaattcttggatctgttacgcaatataagatatcagacaacagatttcccagaacaaccaatgtggaagacaaaatcaggataatcataacgataggataatccattccctgtactgctttaataaagtaaggtccaattcccggccagctaaatacggtttctgtaattactgcacctgttaccagagtaggcagagccataccaagttttgtgataaccggaagcaatacatttttacagacatgtttaaacataatttccgtacgagatgctccaaaagccttttgtaccataacataatcttccgaatactgagtaattgtagaagagcgaacatatcggacattatccggaataaatgccagcgtcagtaccacataaggcataataaaatgtaaaaagaaatctcccagtgtttttacacctaccgtatgcataccaagaatcggaagaattctcaacctgtagccaaacaggtagataaacagcatcgctacccagaatgtaggcatggcaatccataaagaacaaattccatctatcagtttatcctgccatttatttttatgagaacctgccagcaatccaagtacaattgcaatcacataggcggtcagataagaaggaagaaccagtttgattgtgtttggaatccttattgccagttcatcaaagatattggttttcgttacaatagaatagccgaaatttccatttaaaattccctccagccagcgaatatactgcacgtaaaccggctgatcatatccatacttttcacgaatcatctgaaccatctccggagacatcttcggagttgtcatagcatcaattgcatcatagggtgccagatgcattaaagaaaaacaaagaattgtgattacaataatcagaggaatcgcagtaagaatacgttttacaatatactttgccatgttttctcctttttgctttttactcaaaaaaagacggaatccttcactttatttcagaagaattccgccctttgtaaaaataataaatcaatacttacttattttgcaattttcagattggaagtatcctcaaacgtgtacaccggaacaagtcctgcttcttttacaccttgaattctgttgtttacaaccagaatcttattattggaaataattggataaaatgcacctgtgtcttgaatagcagcctgcaattttgcataagtttcttttcttgcagattcatccatctcagaaaatccttcttcaaacagctgatcgattgtatcatatccactgtaatgcatagaattataagcagctccattcttaaacagacttgagaatgtatcagggtcaattcccataatataacctcccagatacatatcatactcattattcggatctttcattgcattagaaacagctgttgcgtctcctcccgcaagttctacctctacaccaacttctttcagctgctcctgaatcagaagtgcctgtgcagactgtaccgggtcactggaactatatccaagtttcaatttcagattacttactcctgcatctttcagcatgctctttgccttatctacatcctgctcatacttctctacaccttcttccgtatagaactgactgtttgtcggcaggaaagtatacggaatgctataatattcatccgactcataagctgcatcatccattgcttttttatccatagcaaacaacagggctttacggacattttcatctgtcactctgttacagttaaactgtaaatatcctatacgaccctcactgtaagaatatgctgtcagattgtttgcatccaaatccagttttttcacctgctgtggtgtcagctgataagcatctacttctccattctgtaaagccaaaatagcagtatctgcattctcaataatctggaatactacatttttaatagcaggttcacctttataatagttttcatttgcctcaaatttcagataagaaccagattgataatctaccagtttatatggaccggttcctactgaattcatgttataatcattatgttcaaagtccgttacatctttatagatgtgttccggcataataaaaatctggctcagcatttccatagcagtaggtgtttcaaatggaaatgtgaaagatacgatatagtcatcctttttttctacttttaccgctccctgatcatataccagctgggaatatgcccaacccagattttcttctttttccatagcctcataggtaaagacaacatcgtctgctgtaaatggttctccatctgaccatttcacatcatctctgagactgaatgtataggttttattatcatccgatacttcacagtcttttgccagaaaccagttgattccatctgcattattcatatacagcggagaataaatcatcttaacagtcgataatccccaacggtcagatgttgtaatcacattaaccgtttctgtcggatctccggaaatcgcataagtaaatgtgtctttaccggaagtttctgtagccgctgtactcttatctgaagctgttttactgtcatcttccgcaaccggatcttttcctccgcaggccatcagacttgcagcaagtacaacagtcagagcaaccacagatgcaagctttgtaattctcttcatcttactctcttcctccttattttctctctttttcagagtcactactcttcattatgctatcagctaaaaacaattttgtcaaacatttcttgtcccaaaaagaaatcaccacatcccggaaatcttacgtggaatgcagtgattttgtcatttttgatttttgattttttctctttttttccgtgtcataatgccaccgattctaccggtttcttttgcagagagactcttccatccatctttcaaaactctgtctaaaagcccgagttcttctgctatctcatatttcactttttcttcgggagtcagactttccaaatcaatctctttttgctttttttgactcattttatactcctttttccttatatgtactctcagaattttgagcgtacaggaattcttattcttttatacaggagtattgcctgaaatttttattttataccgtttctttttattttgggataataattgacgcaataatataagcaataattcctgttcctgcaccaatacagcttaagattacccatgccagacgaaccaacgtcgggtcaatatcaaaatattctgcaattcctccgcagacgcctgctaacatgtaattggttgatgaacgatataatcttttattcgacataataaattcctcctaaattcaaaatcttcctaatttaatatagttcatacagaaatgtaaaaatgaacgttacgattcaaacgttatctgaacatcccccattccacagtcaatgcttaattcctttccggtatcatttttatctaaaaattcatttccaaatccggaggaaagaacgttatctccaatctgaacagtacccattccaacctctgcctctgcactgtagtcctctctttttcctgccattttcatgtccaccgtacctgttccgcaggaaatatcacttacttttgcatctaatttcgccacagatacttcaccggcaccaacctctatctcacattcctgtgctcttaattcatcggatacctgcaaaacccctgcgccaacttccaggtcaagagaagctgcatttaatttgtcgataaccagttgtcctcctccgttcatttcaactgtcactgattcaaactgcatatcctgcgggagaataatctcaatcgggtctttttctccctgatgattctttccttcccgctcaattgaaagttcccggtcttctctgtcatattctacaacatctgcgctattataactctttaccttaattgaacttgcatttgcatccgtcttaaattccagataaatggcatttttttcttctgtttcaatacttaatgaactcacttcctctttgctaaattcatattcctgttttgcttcagtatctaatttcgcatagattgtttcaagcccatcagaatcaaatccttttccgtctgcaagtacattcactttttctgcccagccaaaatattgcatccctttatcctttagaacagaccagtccggaccaattatcattccggctaaaaacaatcctgctccaatcaccccaatcacagctgacaaaatcagacatgtctttgtaaacattttcatacacgctgccctccttttcttcccttgtaaaagattctctgaagaaaatcaacgcatcctcgaaagactatcggaaatccttttccaactatccagagaaagactaacaggattaaaattgcaatcgcaactgctaccataccgcccccggctacaattaaaaagattcccggggatgaaatcaaacgaatgatagctaaaacaattgcagtaattcctgcaatcaaaagtgcgacacctccaatgccaattgctgcaatgattcccagcactcctacaatcaaaccaaataaaacacctaaaatcccaagtcctccgccagcccagattggagaagttaaaataacaagcactatcacaagtccccaggtaagaccgcttcgttttttctgtgtatgctgtccatatctgctttcttcctgatgataatgatttgtttctttgagcatatctttcttatcaaaacgcacatcctgataaccctgttccgtatactcttcatagtctgcttcatttccggaaaggtctgctttgataatcgcagccaccttcccggggcttcccagctcctgaatcacctctgcttctttctcttttccggcatcatcaaagtatccattataatattccaatgcctcttcccgctcctgcgcaggaatgtcatacaaaagtcgttccagctggcttaaaaattcctctcggttcatactcacaacacctctccctcaaataatccgctaatctttcccgaatatgttttccattcttctttatacaaattcaattgtgccattcccttttctgttaccttataatacctgcggtttctgcctccaaattcctggtcataagtttccagacaatcatcttttaaaagccttcgcaaaaccggatacaacgtagattctgaaatctcaagcacctgccgtacatcctgcgtaatcttatacccatacgttccctcggcttcctttgagacaacagcaagtacaattgcatcaagtaatgctgcacctgtattaaaaaccatgtatgctttcacctctttttttgtagagttatttcttatacaatactatacgtcatataatatagttttgtcaataatattatattaaataaatcttaaggttttataaaacaaaaaaatggaaggttttttatttttctaaaaaaccttccattttctttacgctactttctttactctaccgcaaatgcccgctccaaatttacagaataaatatatttttcttccaccggcttttccaacatccgctccagtgctttctgatagtatttcagctgaattccatactttccaaccaagtcactgccatcccgctgttctacataatctgtcttgtaatccaacaaaacaatttttccattttcttcaaaaaatgcatcgatgattccctgtaccagcatcgtctcttctcccgtctctgtttttaagatatctgaagccaaaacttcaatgacaaagggctgttcacggaataaacatccctcgctttgcgcctgtttcattcgttttccaattctcgaattagccagtgcaaaaatcttttcaggttttactgttacataaaccgattcatctattttttgttcttctctaagttttgcaagctgattttttactgccgttttggtatccgtatctgtaaaatccagccactgcagtaccttatgatacgcatttccgcggtctaccccgactaaaacctcgccttcttcctgcataaatgccggaatatatggttcaatttccggcaattcttttatttcttccttctcgtctgcaagaagttcttctccaagaatctgatccataagggaaactctttcctcaaaggaaatgctctcttcaaaggaaacactttcttcatcttcaaactgcatccgtttgacttctgaaactgttaccttagccggaacttcggcttctttctgccacggatattcccacaaaaaatgttcctgtatttcttttcttattcgttcatctgaagatgcacgctccatttctgcaatcaattcctgctctttgattaactgctcacttcgctcttttgcctcacttaaaacaaactcaaccggtgattttacagcaatcaaaaatggagctgtttcttcatgcaatgaatgactcacagggcaggaatattcatactgctgatacaatccatccatacagcggtgtcttgcaagtgccggaaaaatccagtccagatacattctcgctttcacaagttttccataagacagacgcattttttcttcattttttatcagttcaagtccttccacacgtttctccagtctgctgactgccccagtcagatataacttttcttttgctctggtcaaagctacataaagcactcgcagttcttctcccagattttcaagctgaatctggcgctgaacagctttctttaataaagtcggtgcttttgttctgcgttttgtatcaatccagtctgcaccgattcccaaatccggatgaatcacaagtgacgctctggcatcctgctgattaaacaattttccaagcccggatacaaaaacaatcggaaattccagacctttgcttttatgaatactcataatctttacggtattttcctgacttgccgtgatgtctgcttcaccaaaatcaatctggtatttctgcaggttttcaatataacgcacaaagttaaacagtcctcgatagcttgttttttcataatctcttgccttctcaaaaagcatctcaagatttgcttttttctgttcgccaagcgcatttgccatataatattctatcagtccaaggctctcataaatatcccataacagctcatggattggtgtataggcaaccttcacacgcagggtgtaaaactgttctagaaatcggctgatttttctttgaatttctgccgctccgtctgttttctcatataacaacatacattcaaagaatttaagcgtctcatctgaactttcttttcccgcacattttatctttgccagttcttccattgtaaaggcatccggcagatttaaaagcactccggcaaatggaatatcctgaagcggattatccagaatccgaaggtaatttaaaacagttacgacttcctgtgccgagaaatatccggtctttgtcgttacgcttgcaggaattccacgactctcaagaatctttttaaaattttctgcccaaccattcatggtgcgcagcaaaatcacaatatctccatactctgcttttctataaccgccattttctttatctacaaccggaaactttccaacgatttcctgaattttatccgccacaagtcttgcttcaagttcctgcacattttcttcggtttccatctgcttccattcggcttcatcgctttccaccagcaaaagttctgtttctcttaacaccggctcactattttcctcaaacaccgctccggcatagagtgccgcatcttcatcatattccactccgcccagactctctcccattatctggtaaaagataaagttgattcctgctaaaacttcctctctgcttcggaaatttttatgcaggtcaatccgcaccttatctccggctttctgcaaatatgaatgatatttttccataaataaatccggtcttgcaaggcggaaacgataaatactctgcttgacatctcctaccataaagatgttattctgtccctcttccatccttgataccgcagttagtaatttttcctgtaccagattgctgtcctgatattcatcaattaaaatctcataaaaatgggcagaaagttccttcgctgcctcacttcgctcatccccattttccgtatgatgaatcaaaatttccagtgcaaaatgctccaaatccgaataatccagcagattcttttcccgttttttctctgcaaatgcttccgaaaaacgaagcgtcaaatcaattaaaaccccaaccggtcctccggcttcctgcagatatttagctgctgtttcaaacggcacaccaaagtactgttctttgatttcatttaaaccgtctttgatttgatttcgataattttttaccagttcttttttattttccgatgcttccggcattttttttcccgataatcttgcataagaaagatgggaaaaaacctcctgctgtgcttcgaaactgtctgcttttaacagcagttccactgtttttaaatcctgacttaaggcttcttcgtaaagatatggtccatcttcctgccgacaaagtgcaattcctgcttctgcaagcatacggatttcttccagatttttttcgatatcggactttaacaactgcatccacggtgcctgctccacttcttttactgacgaaatctgatatgcatctttgcaggataccagccattcttttggatacggataactcgtcgaaaaagtatacaatttacgtatcaattccaccaacccatcatcagaacgccctgtggaaaacgcctccacaaactcatgaaattcttcactgccctcttcataagcctcgctcaaaatccgctcggccacatctccctgaagcatacgcagttccccttcttctcccacacgaaaagacgggtctaagtcaattaaatgaaaataatttcgcacaatatacgcacaaaaactgtcaatcgttgtaatcagcgcatgatgaagcagggtattctgctttcttagatgctctaacatctgctcttttttcggactgtcttcctgcttctcttcttcctcgattcgagcttctatcgcaagtcggattcgctctctcatctctcctgctgctgctcttgtaaaggtcacaattaaaagctcatcaatcgaaaccggatgctccaaatctgtaatcatcgaaaggattcttgccacaagcaccgctgtctttccacttcccgctgccgcactgactaatacatttgcatttctcgtctctatgactttctgctgttccggggtccatttcatttccatttatttcttttcccccttttcattttctgctttttcgctctcctgcatctgctcttccatgcctttccagatttcctcactttttacctgcgccagtctgcggtatccacacccttcttttttctcatcaaacccacacgcaccttgatatgggcaatactgacaggcatttctttgtcccatctcataaggtgaaaccgacgcttctccctttaaaatacgctgtccgatttcctgtatcttatgtttgacatagcctgaaaccagttcaaaatgttcctcatctaccgcactggaagtcttagaaagtcctccgcttttattgatagaaactggaatactgtttgaagatacccctttttcttcgagtcccttgtccagacgttttaaaatctccgggtcggcagatgccagtccattcattctaagctgctttaacagtctctgatttaaagactcttccgattccttttctacacaatctacaatcgggtctttgatattataataaaaaatccctgccggaagtacgtttttatccggatgagctctttgttccagttccattgccgcatttaaatacagcaccagctgaagctgaagtccgtgatacagtgccactaaatcaaacgcagtacttcctgatttatagtcaatgacttttacatagacattttcagaatcttcacacacatccacacggtcgattcttccctttaatttcattgtctcctcttctgaaagcgcaatattaacgctttctaacgaatctgccattgcaaaggaaacctcaaaccggctcggtttaaattcgccctgttccatctgttttgcaagtgcccaaaccgttcttcgcatcattcgtttgacacgattgaccatataagcatttctcgcatcactttgaagcacggtattcccataggaatcaacggcttcttccacacaggaatctgcgagtttttccatctcttcgagactgatttcatcccattccacaccctgttctttgatgtgtcttgcaaaacgttccaatccagaatgaagcacatttcccatatccattgcattaaattcataggccgtacgttcttttaattccagcccgtaagagaggaaatgtgcacaggcacactttgcaaaaagttccagtctggtcgcactgttttccagtatctgtccatacagtgcctttgccacacttcttccgatattatcagcgattttctttggaaatgcactcttcatcagaccttttactctctcctgccattcttcctgtgaaacaaaccacaaaaataattcctgccagtatttagacggtgtctcttttcggatattctgaaaacctttggcaagatatgcaaatgcctgctccgtcttttcaaatgcaaaactgtcattttgtctaactttttccaccggcaaatccgcaaacatctttcttaaatttccaatcaaaaaggaaggaagtattgcctctccatctgccccctgcttgctgtaagagaggaataactgatttgatggcttcgtcagattcaaatacagataaaatttctgtgtatacagattttctttcgcagttggcgcaagcgctacttcagacaatttcaaatcttcacggtttaattctgataaaatttttccaccaccatcttctcttggaatttttccatcattgactccgacaaaaaacaaaacctgaatgtcttttaaacgggttcgctccatatctccgaccagcacctgatctgtacttggaggaataattcccacctttgcctcagaaagccctgcctctaagagttctttaaactcccttaaactgacactttcttcccccaaaacctgcaccattttatcaaataaatccatcacaatggcataaatctgactgtattcttttgcctttccaacctctccgtgtgcctcaaaatactgctcacttttctttaatttctgctgaattctgcatgaaacaataaactcataaaaggctcgcacacgctccgataccgtagcttttcgcactttcatacgcaaagtaaatccttccaaaagctccatcagacgaactcttaaagcttcaatttttacaacttcctctggattttctccccgataagctaatgtccactccttctgccacttcttccagctcttaatacccattccaagcatatagttttctaagacgtccatttcttcttccgtcaaatccaaaagcccgcatcgaagaaaacgaaacacactctcatagctataattttctatcagcatatcaatgcaggcacgcagaaattcaataaacggattcataagcacagtctgtttttcatcaataaaacacggaatttcgtaacgttccagcatcttctttgcataatctgcgtaagtatccatgtctgccgtaatcactgcaaaatcacgccaacgcatcttcttttgacgtaccatccggtgtatcattccggaaacatattccatttcttctttgggattggcacattccaaaacccttatcgaatcctgtctttcggtataacagtttcttttagaacgaaataaattctgctctaaaaatgccagtgccggctgatggaaaaaccttgcgtttcccttaattttcacatcgtccaccggacagccgactcttgacgctgtctggcacaatctactcaccgtctgcttacttaaataaaacagattcgtcgcatcactctgcacataaggacgttccccttccccgattgtaaccgtcacatacatttcttcgcagaggggcagaatcttctccagtacattttgctgaatcggtgtaaatccggtatagccatccagaaccagtatgctctcttttaattttttcgactttccggctacacttccaagcacttcaagcacttcttctcttgtgattgcttttccttccagatactcaaaaaagccgtcataaagcactgcaatatcctttaatttatagtaaagttccggcttatcctttgcacactccagcattttttccatgtcttcttttgagacttcatactgccgaagctcagataccatggatttcatttcagagatataaccctgtcgtttcattttttcgccaagcacacttaattccttcttatgattttgtgccacttttcggataaccagactctttccggtctcttctaacacatcctcacacagataacctgtttcttctaatactcgaaaagcaagacgttcaaaacttaagacatcaatatttaaaattccttttcttggatgcatccggaccagttctttctgtgtctgcatcgtaaactgctctggtactaataccagatattgcttcttcggattctgaatggattcccgtataattttctgataaatataataagattttccggcacccgatgcgccaaacacaaaatgtaacgacatgcgtttcccctttcttacaactaactgtttctgtcttttactttaggaaaaatttttcaatgacctctgcaattccatcctcatcattactatttatggtaatataatctgccacatcttttactttttcctgtgcatttgccatagccaccccaagacccgcatactgaatcatggaaatatcgttaaatccgtctccacagcacaccatctcttccctttcgattccgagaatctttaacagacgttccagacaatatgccttatccacatttttcggaagcacctccaggaaatatggttccgaacggaatacctgcgcttctaactgatatttctcggcaatgactggttcaatactctctaataattcaccgtcagccgttaaaatacacttgttaaccggaaaattgacataagatttaaaatccggttttttaatcacaggaagtgtcgtaattctggattctatcataatatattcatccggtatttttgcagaaataatagaatccccctcataagtcataagacccgttccataatgcatggcatcgtcatataatttctttggaatcccaatcggaagttctttcgagtaaatacattcttttgttttccagttaataattcttgctccgttaaatgcgagcacataacttccatactcagcaaaatccagttcatctgcaactgccacaattccctttgtcggacgacccgatgcaatcgctaccggaatcccttttttttgaagttctaaaattgcttcttttgtcttttgggtaatctctttcttagaatttgtcactgttccatcaatatccaatactaataatttataactcatttttaaaaaatcctcctcaatttctcagatgtttaaccaaatcaagtaagtcccctgcttcaattgcgaaaagcaataagcaggggtggggacttgcttgtatcaggagggggcaatccccttctgataagctgcgtagcagctatttggttatgagcaagtagcgaagcggattgcgaatatccacttgactctgaaaccagtttaacacaaaaagttttctcaaccaacctcgttgggggcatatttttctttttctcctaataaactatgatgtgagtgtcaaaaataaattttgccactcgctgatgtatccggattgcttcattgctacgcaattctcacaatcctcgaacacctcaaactctcataaaatggcatattcataccattttattacgttttcgttgttcggcgtgtcaattaaatataaattgctttttatgcaagcacaaccgcaatttatatttttgacacttacatcaagttataaaaaggaataccaggagggaatactatgagtgcgaaaaccaaaattgttgtactacatacgaaagaagtgatttataccgtgctttttgttgtactcgccattgtgcttgcagtccttctttttttgatgttcggaaaagacaaaaagaccacttctttctcaggctctcccgccaaatatcacgccggtatctataaaagcccaattacgctcgataacaacacctttgatgtcgaagtcacggttgatgaacatgaaatcacctctatctccatgacaaacttaagcgaagcaacaactgctatgtatccactgatggaaccggcactcgaatcccttgcgaatcagatttatgcaacccagtccacaaaagaccttacttatgccgaagaaaataaatatacttcgatgctgttgttagatgcaattaactcggcacttgataaagcaagggcagattaagaagatctacaaaaaatggctccgaacaaaagtccgaagccatttttgctgcctactatgtacttattatttaattgcaccttctaccataccctgaataatctgtttctgtgcaaacaggaacaagataataatcggaatcatggcaagcagagctgctgtcaggattaaatcccattgttttacataagaacctacaaaactgcttactgcaaccggaagagttttgattcttccgtttaatccaagcatcagagatggaagcaggtaatcgttccaaatccagataccatttaagattaatactgtaacctgaattggttttaacagcgggaagataattcgaaagaatgtaccctcaggactgcatccatcaatccatgcagcttcttccaactcatacggaattccttttacaaaaccatgaaggatgaatacagacattgaaccaccgaatccaagataagcaaaaataattcctttgtaactttgaagcatctgaattcccaaaaactctgaagtttcacggaaagtagataacagtggaagcattacaacctggaatggaataaccattgctgatacaaataacataaaaatgaaattagaccattttgttttatttcttactaaaacccaggctgccatactggaaaacagagtcagtaaaatcagagatactgctgtaatcaacagggaactaaagaaagaaccccaataattaaagttatcattatggataacattgctcatgttggtcaacagctgtccccagttttttggtaaagaaatcgggctgatgacaatacttgcactatcctttgcagagttgattataaccagtaagaatggagctaacatcacaattgtcagaagaattcctacaatctcagcgattgttgttcttattttctgtgctttcattacatttcaacctccttctttttactgattgtaacctgtgtcagagacacaattgcaagaataataaagaatataaccgctttggtctgaccaagtgcatactggttctttccaatcgctgtattataaatattcaatgctaaaaattctgtagactgtaccggttttccggaaagaatacgagtcggtgcaccattggtaatagcaaggttcaaatcaaactgtttaaatgagttaaccaaagtcaggaaaatacaaattgtgaatgtatttgcaatcatcggtactttgattttcagcagagtctgaagtgtatttgcaccatctacattggatgcttccagaatatcttttggcacactctgtaaaccggttacataaatcatcatgatatatcccgcatactgccaggtacttacaattaaaattgccacaagcgcaaggttcgggtttgtcagcatggaaacacttcctgaaattacagaaaccgcaactttattgaaaatgaactgccatacataaccaagtacaattccaccaatcaggttcggaatgaaatatgctgcacgatagaagttacgaccttttacttttgaagtacaaagcagtgccagtgcaaatgctacaatatttacactcagcatattaattactgtgtaaataaaagtcacaacaaaagaatatacataatccttagacttgaacattgcaatgtagtttccaaatccaacaaaattatcatattttattccgttccagtctgtcaaggagtaaaagataccacaggcaaacggaataagcacagttactgcaaatgcaaacagcagtggaaataaaaataatacataaataattgaacggtgtttcttcgttggcagcaggtaaagccctacaataagcaataccgctcctgcgattaaaagtcctccccgaaaggaagttcctgttctcataaaatccatgtacagtgccgctgccattgctatgattccagccacaattgctgcacatgatattgcttttttcgactgattcattcctaactctcccatcaaatatttaccggctgtcttataacaaagacagccgataaaacctattatttacttgatgctacataatctgctattgaagaagccattgtacttacaaatccctctttatcaagctgaccttttgcatacagctcaaatacaggaccagttgcattcatagccatgttatccggctgtgttacccaatcccatgcataagtttttccagattcaatataaggaagcatactctgtgcaagtggtgtagaaggttttaatgtacaagatttaaatgtagaaaccataccgcagttttctacaagtgctttctgaccttcttcggattcagcaagtgcttttaagaattctttacaagcatcaattttatcactcttattgtaaattccccataaacttggtgtatcaacgataagaccgtctgtatcttcttttgtaaatgctgatggagcaagtccacatgcaaatgttgcatcataagttggtaaagatgggtcaatccagttaccctgtgtgataaatgctgcttttccggttgcccacagagccagctgatcatcataagtaccggaaatcaatacattctggtctgagtaatcaaataataactgtaaccagtctgcgaactgtcccattctatcttcatcaatttttccttcattgtttaccatatcaatatatgttttatcatcacggtcaactccctgtgaataataagctgctaataagtggttaccggttgaccagtacatctgtccggattctgctgcaactgcacaaacagatgtcagtccaagttcatctttcataccgtcaattttttcaaatgctgctttataagcatcaatgtttgtcagagtagaaggatcaattcctgctttatctaagatatctttgttatatgcaagaccaattccttccagtgagaatggcataccatatacttttccgtcatctcccttaaatgcgtaatcagtatcttcaatccagtcttctccgtcaagtggttctaaccagtcactgaaagaagatttataagagtcaggaccaaatgcaaagatatctggcatgtttcctgctgcgtagtagtttttcagctgaccatttacgtcaacaccgccacctaaagattcgattacaacttcctgtccggtttcttcttcatactgttttgcaaaatcttttaaggccgagtcaatttcaatttttgtatttacaaaacggattgcatctttattggcactgcttgaagctgcgctggaatcactggagctgtctgaagaactgcttcctgaactgcttccacatgcacctaatgtcattgtcatcgttcctgcaagtaaaactgctaaccatttctttttcatctcttttaccaacctttcttggaattttcatcttttttctttatcacttatgcgcataagttcttgatgaaattatcatagcacccctttcgttaaaaagcaatactttttatatgccattctatacatttctacattttcaccagtattactacttattttcatggtattgcaacctattttttgtatattttgcagtaataggtttttcgcaaaaccttttttcgttcatttttcgtttatcttatgcgcaaaagtaattccatttttcgacttttttcattttgcgcataagtattttgaagtcaaaaaatgacattctgctttcggcaaaatgtcatttttctgtctcttattttctatattcttaaattttttttacagaatcccgaattacaagttctgttccaagctgaacaattttatcttcggattctccctctatcagttttaatagttcctctactgctgcaattccttttgcctgaatgtcctgtcggactgtcgtaagcgccggacgcaccattcttgaaattggaacatcatcaaatcctgcgatggaaatctcttccggaatttttctttctctatccaaaagcatattttcaatgtgtaccgcataataatccgaagcacacagaagagccgtatacgaaaatgatttctcataaatctcatccatattttgaggctctcctgcatcgctggcataaatttgaataaaattttcttccctacttaccggaatgttcgcttcttttagcgccctgcaaaatccctgaaatcttattttatccagatttaccaagttatcagcaaggaaagcaagctttctgtgaccacacgaaataacgtattttgtcagcaaatattccgcctgttcatcctcgatcctgatattgacacagtttcccagaccatttgtatcataatcatcaataatcgcaatcggatttttaaggcgctcttttaaataacggatatcaccctctacaaatcctgaagtaatcagcccgtccatgttccaggacatcgtaaactgctgaacctgatgcacatcgtcgactgcatataccatcaggtaatatcctttttgccgtacatgcctttcaatcgcacctaaaattctaccaataaatgggtcttcaaatcggttcgctatcttattctgttttgatttaatcaacaagccaataatctttgatcgtttactcgcaaggtttcttgcattgatatttggtgtatagtcatatttttttaaaattttctgaattcgttcgatattagccagtgaaacttcttttgtcttgccatgaataacattcgaaacagtcgttgtgctgactccgagctcctgcgccatttctttaattgtaaccattctttactcctgtttttacactgctcttctgactgctcccacaggcagacctatggattttcgccataatttatagcagttttacttctatttttttctcacgacttccagtatacacacaatttccacctttctcaatagtgattctgccataattgtccggattctcataatcttttcccattccatcatcttcataccacacatattcggcttttgtctttacaaatgccagtgctttgacatggtcacagtctacttcatctgcatactcgccaccatctgtcagtaccaaaattttatccggacgtacgaaaactaacatttcaaacaagcctgcttctacatagtgatgtcctgccgggagaatttccgtatcgtaatcatccacgcctctaaagcgaagcattgccatttcctccggaagatagacatatctgccttttgcattctggttataaaccggagcaatcattaaactgtctccaaccaaaagctggtcttctacctgagaagcaaattcatcatctgtatatacaaaagataatggtttgaagtacatttcactgtttaaggcagatttcatatactcgctgtaaatataagccagcagaccatagcgaatattaatgatttttctaaattcttctacatggtcaaaacgatatacttcctgttctcttgttcccattgcactgtgatttctcatcagtggagagaacatggcaagctgggtccatctcatgaccaaatcttccgttgcatctgcaccaaatccaccgatatctgcaccggtataaagaattccaaccatgtttaaggacggcatcatacgcagattcaacaacagatgattccaccaggatttattatctccagtccagattccaccataacggtgcatgccaatataagaagaacgagagaacattaaaattcgtttttccgggctcaggcgttcaaatgcctctcctgccgcacgggtcatattataaccaaacaaattatgtactttatcgtggcgcatcatttttccatctacgttatgatagaacttcttaaagtcatctgtattgtttgccagacttccaaccagaccggtaaactgctggaacgtatccagatcaaggtttttatctttcaattctgcaatcttatcaaaggtttcatccattctatcctgtgcaaagaaaatagacggctcattcatatcattccagaatccttcaattccctggtctaacagcacctgatatttatttccaaaccactctctcgcctctttgtttaatacatccgggaaatgcacttttccgggccatactccggctacaaagtattctccattttctttcttacagaaatagcctttttcaatgccttcttcatatacgtcatagccttcttcaacttttacacctgcatcaataatcggcactaaatgaatgtgctgtgctttcatctcttttacaaactcaggaaaatccggaaaacgttcctgatttaccgtaaagtctttaaaccgctccatgtaatcaatatccatgtaaatactttcaagcggaattttcttttctctgtgtccttttactacttcacggatatcagcttcattcatataaccccagcgactctgctgatagccaaatgcccacttcggaggaatatagcttcttccaatcagctgacgaaactgttttacaatgtctaaaatgctttctcctgtcattacataaacatctgcatccggttcacttaatgtaatttttaattcatttaaatgcgtatatcccacatcaaatgtaatgattcccggataatcaaaaaacacaccaaattgctcttttcctccatctaaaactaagaagttatgagatgcatataaagaggtacggtcctctaaatggttcggttcatctgcgcagcagctcttataaatccagcctctcttgttaattccacgtacattttcacccagaccatacaccttttcttcgttttccagtgtatactcaaactgaagctgttcctccgtttttgccactgtaaaatacggaacatccccgttctgtacctctaatttttgtaccactgcatcggtctgaaatggatttccataagtgtattttgttatcatgtcttaacttcctcctttattttttatgtactctcggactctttctgcctttacacatattagcccattttcagttccattttttgtatcatagcatggcattttatttctatcaatcccttttgcgcataatccacatgtgatacaataatttttccagtatttcggcagtttttcagtttattttccgcaatttcagtcaaatatgccaaaaaactgccggtgttgtccgacagtttttttgatttttattttctataatgtttccaactcttcaatccagattcgaacacaggcatcacttggcattcttaaatctcctcttggagaaactgccacacttccgaccttcggtccatccggaagacaggaacgtttaaactgctgagagaaaaatctccaataaaattttttcagccattttaaaatcacttcttcttcgtattttccttcaaaggctttttttgcaattcggtaaatttttttcgggctgcactggaaacgaagtaaatgatacaagaagaaatcatgcagttcataaggtcctaccaaatcttctgttttctgggaaatcaccccatcttttggaggaagaagttccgggctgaccggagtatctaaaatatccagcaaaatatcagaaagtgcttcttcgtcgcaggtgtctgcataatatcttacaagatggcgcaccagtgttttcggcacagaagcattgacgccatacatggacatatggtctccattataagttgcccagccaagcgcaagttcggacaaatcaccggtaccgattaccattccgccaaatttattagcaatgtccatgatcacctgagtacgctctcttgcctgtccgttttcgtaagtaacactgtggtcagacgggtcatgtccaatatcttcaaaatgctgagtcactgcttttttaatatctacttcttttaaggttgccccaagacgttttgtcaactcacaggcatttgtgtaagtacggtccgttgttccaaaacatggcatagtgactgctaaaatctgttttctgtcaagtccgcataaatcaaaggctcttgccgtaaccaaaagtgcaagtgtagaatcaagtccaccggaaattccaagcacggcgcactgactctttgtgtgttccagacgttttttgagtcccattgcctgaattgtcagaatttcatcacatcttctgtctctttccccttttgcatccggcacaaatggatttgcatcgataaaacgttccagttttgtctcggttacatttaaatgaaatggaatcacctgataattttcttttccctctgactgccaggttgtattttttctgcgctctccgactaaacgactcatatctaacacactgtaaatcgtttcatttgcgaagcgttttgcttcttttaaaatcgtaccattttctgcaattatattatgtccgctgaatactacatcctgcgtggattctccatttcctgcggaggcataaatataaccacaaagcagtcttgcagactgaccggaaaccagatttcttctgtactcatcttttccggtcgcctcatcactcgcagacggattgataatcaaagtagcaccagaaagggcatgagaaatacttggcggattcggtgcccacaaatcttcacagacttctactgctgttacaagctgtggcagttcttcacagacaaataagagattttgtccaaaaggtacttctcttccgtaccagtttaccattccctcaaatgcacggcctgctgtaaaatgacgtgcctcataaaactctgcataattcggcaaatggtgttttggcacaaatcctaaaacttttccacccgaaattacagctgctgtattatacagcttctggttaaattccagcggaagccccacaataatcaagccttccacttcttctaactcttcttcaagtttgtgaagttcttccttcgcacgcacaagaagcagttcctgccagaacaagtctgaacaggtatatcccgtaatacaaagctccggaaatgccatcacctttgttcctgcttctgccatttcttttactttttttacaatctcttcccgattgtgcacgcaatctgccactaaaatatccggcgttgcagctcccacttttacaaaaccgtctctcatctcgtacccgacctttccttatgctcttgtacagcgttttaaaatacttttcagttcgtctactgtaaagatataatttttattacagaaatgacaatttaactcaatttcttttccatcatcaatcatttctttgatttcttttttaccaacactgattaacgctttttccacacgttctttactacaattgcaatggaactgtgtcggcactgtctccatgatttccacatcgaatccatctaaaatcaattttaataaactttccggtgtatgtccttcctctaacagactggtaacagaagttactttctttaagttttcttctaatttgttaatcacttcgtcatctgtaaatggcattaactgaatgataaatcctcctgcctgttttacggtattgtctttttccatcagcactccaagacctacagaggacggaacctgctcacttgttgcaaaataataagtcaaatcttccgcaatctcactggtctgtaaaacagtctgtcccacataaggctctttcatccccatatctttgatgacgttcataaatcctacgccaaccgcaccggcaacatctaattttcccttgtcattagcatgtaaaataacatttggatttccaacataaccttttacatttcctttggagtctgcagttactgtgattccctcaagtggtcctcctgctttaatctgaagagttaaaatatctttttcccccttcatcatcacacccatcatgcttcctgcagtaagaagacgtcctaatgccgctgttgccaccggacttgtattatgtgctgctctggctgtctcaactaattcttttgtggttgccgcaaacgcacgaatctgattatttgcggcagttgctcttacaatgtaatctcccatttatttccaatctcctaatttttcttttttccatgttctcttgcaatcacataaatccgttcacttttttcattcaccggatttttcgtaaatgcatcataagccgtaacaaattccattccggctttttctaacaattcttttaccagctccaactcataagctcgctgataatgaacttcttcatattttcgataaagaccatccttgccctccggaataaacaatgccaaatcatattcattaatttgttcttcttcatcataataattatcccagataaagctggcatcctcgcgattctccgcaatcgtctgttctccaaggattttttcatacttatagacggtatttaagtcaaaaataaaaacaccctccgggtcaagataattgtttaccagtttaaatacttccagcaaatcctcatcctcggtaatataattcatgctgtcacaaattgagacgatcgcttttactgttccatacaattcaaactcccgcatatcctgacaaagataaaggatatcctgaccttcttcctctttcttttccagtgcaatttccagcatatccggtgcattatccacaccaatcatatcgtatccggcatcggagagcagtctggtcgcatttcctgttccacagcccaattccagtaccagtccgtcatctacttcatattcttttaaaagcccagtcaggtagttacaccactccttgtagggtatgttatccatgaacatatcatacacccgggcaaaactttcataagcgctcaaaaatcattcctcctgtgcacatattcttttttatcttaacataaatcaggtttgcggtcaaaaaaaatcgactgtacccttaagcacagccgactaatgatttatgccctctcagaatctttgtatacacgtatcataaagactccaaacgttcattttatttttttataaacctgttttttctgcaatgaattttcttgctttgattgcatattctaaaggatttgcctttgcaggatcctgttctgcttctactaacatatatccttcataacctgcatcttcaagcactttgaaaatcgggtcaaaatcaatacatccatcgcccggtacagtaaatgttccaagacgtacaccctctaagaagcttaagttttcattttttactttttctactacttccggacggatatcttttaaatgtacatgtttgattctgctgacatatttttttaccatttcaagcggatctgctccacagtaagtaaaatgtccggtatcaaataataagctgacatattccgggtctgtattttccatcatacgctctacttcatccggattctgtacaacagttcccatgtgatgatggaaagtaagagaaattccgtattcctcttttgcgatctttccaagtttgttcattcctgtacagaatgtatcccactcttcatcattcattacatatttatgtccaaaaatcggagtgtcctgcattccctgcacactgtgactctgttcagaagctccaataatctttgcacccattgcctttaaaaaagtcagctgtgcacgaaattctttttctacttcttcaaatggttttgtgattaaaaaagaagaaaaccactgattacagatctccacgccacgaagttccaatgcttttttcagaacttccgggtcttttggatatttatttcctacttcagaaccggtaaatcctgcgagtgccatttcactgacacactgttcaaatgtattttcttttcctaaatccggaaggtcgtcattcgtccatgcaattggtgcaattccaagttttactttttctttattaaacattttttctatctcctgctgttctttttagtcaagtggatattcgcaatccgcttcgctacttgctcataaccaaatagctgctacgcagcttatcagaaggggcttgccccctcctgatacaagcaagtccccacccctgcttattgcttttcgcaattgaagcaggggacttacttgatttggttaaaaaaataccacgaaagtctctacataatttcagaaattttaaccggtctgtgttcttctaaagatttcttagctgccagtcccattaataccggttttaatccatccattacgttaagaggagtttctttatcattttcaattgcatcgataaatgctgcaatttcttttccataagcatccatgtatctctctaagaagaagaacaatggtttttcacctgttacaccatctgcgttgctgataactgcggaagactgactgtcatttttcatagaaaccataccttctgaaccaaatacttctgctctctggtcatatccgtaaactgcttttctacagttatcgataacagcgattgctccgttttccatctgaagtgtaataacagcggtatctacatctccggcttctccgattgccgggtctactaagtttgcaccctgaacataaacttctgttgcatcgcatccagctaagaaacgaaccatatcaaaatcatgaattgtcatatcaaggaacattcctccggatacttttacataatcaatgcttggtggctcagggtcgcgggatgtaatcttgataatctccggtttaccaacctttcctgctgcaactgcctgctgaaccgcttcaaagttatggtcaaatcttctattaaatccaacctggtattttacgtttgttccttttaaggcatcgattacttcctggatttttgcaatatcatggtcaattggtttttcacagaaaacatgttttccggctttgattgcctctaaggaaatcggggaatgggtgtctgttgaagaacagattaaaactgcattgatttccgggtcattgatgatttctttgtaatcttttgttgtgtgttctacacccatgctctttgcccattctgctgtttcatcatttaaaaatgggtctgcaactgttttaatcactgcatcttttactcttgttgaaatacttgtgatgtggactcttccgattcttcctgctccgataatacctacttttaccattttttcattctcctttttatgaattttattgtttttgttttctcttgcgtgcccgagcactttctctttatgttgttataataccattgcgtgcccgaaaacgcaactcggaattttgtacaattttaccaaaacaattctatctaaaattaccaaaagcaggaactcggcttctgcatctgattcgccgatagactggcaatatagcagaaaatagtcaagtggatatttgcaatccgcttctctacttgctcataaccaaatagctgctacgcagcttatcagaaggggcttgccccctcctgatacaagtaagtcccctgcttattgcttttcgcaattgaagcagggaacttacttgatttggttaaaaacaaaaaatgagaaaaattacagaacatgacaattttgtaatctttctcaaaatataatcagccgatattattattttcaattctaagcatacgatatccaatgccaatatgtgtctggatatattccactccatttttctcaggctcaagttttttccgcaaggttgccataaaaaccctgagagaagcaatatcgttatctgaacatcgtccccaaatttgctgagtaatatacatgtgggtcaacacctttcccacgttacgtgacaagatgcaaagcagcttatactctataggtgtcagatgtagttcctctcccttcagatatgtacagcctgccataaaatctatctttaactctccattttcaaaaatagatgttttgttctgttcatctgtctgtgttatcgtaagtcttctctgtgtaacacggatacgtgcaagtaattcctctactgaaaatggttttgtaatataatcatctgctccggcatccagcgcctctattttgtctgtatcttcacttctggcactgatcacaataatcggcatgttcgaccaggtacggatttttcttatcacttctactccttctatatcgggaagacctaaatccagaagaacaatatccggattatgggacgaagcctccaaaatcgccgaagagccgttttccgcaaccaaatatttataatcatgtgtttttaatgtagtaacaatcaaattacgtatgggtttgtcatcctcaaccaccagaattaatgttttattcatttaatgtcacctcgcttaatggtaaagtaaaaataaaattgcatccatgaggagcatgatccgtcagaaccagagttccattatgttcttctatgatagaacgacaaagtgccagaccaagtcccagacttcgatgactatccgcaattgttgtttttcctgtatagaacatctcaaaaatatgcggcttcatttcatccgggattcccggaccgttatcttccacacttatctgtgctttcccatctgctttgattccacgaatacagataatagaacccggtggtgtatattttattgcattatcaattaagtttaccaaaacctgtataataagacgtacatccatacgtgcaagaacaagctcttcacagtctgtcactattttatactcatcatgcttcttgttaatatgccgcagagactctgcaatcacttcatctaaaagctgatctgtaaatttaattttcagtcttccgtcattcagtctggtaatagaaagcaaattctccacaactccgatcagccattcagaatcatcataaatgtcagtatagatctgagcctttgtagcctcatccaaacggtcgccattgttaaccaacatatctgcattaccggaaatagaacaaagtggcgttcgaaggtcatgagagattgcccgcagaagatctgcccgcatctgctcgtttttggccaaaactgcatttttctctttttccatggcgttttgtgcattttccattgcaagcgcacattcatttattacagacagcaggatactgtattcaaaatagtccagtgtttctttttgcattggtattccaattacaccgtaaacattgtctccaccccggattgccagatataagcatttggcctgtggaaaatgatgagtggaagcaccggcacgctgcctgttttcatagacccatctggctacaccctgttcttctggtgttaatatattttttgcactctctttttccaccgaaaaaagttttccatctgataaatttccgttttccactacatacgctgtaatattgcgatttaataagcgaagaagctgagtacaggtaatatcaagaatctctgtccctccttttgccttttgcagcaggcaatctgtatcaaacaaaacttgtgtacgaaaagcaagctgagcagacaattttgcatgtgttttcagctttgctgcaagtgctcccgtaagcacagatgaaataagcattatgagaaaagttaccggataccctaccgcataagtctgaaaagacatcctgggttctgtcagaaaaaagcaaaataaaaaaacacttataacagatccgaccacactgcaaagataaccatctgtcaaaattgaagtaagcaaaactcccaatatatatatcgttacaatatttgtatccgtgaaattcagtctctgaaacagaagaccaatcaaggtacatactgcaaatataattaccgtgaggaaataatctttcgctgacggtttttctacataccttgcaaatgacctcttttgatgagttctggtttttagcgcatccggaataatatggatatcaatatccggtacaatttcaatcagtctttctgtcagagttgctttgctgaaaaagtgattcctcctggcattactttgtccgattacaatttttgttacattggataatctggcatactctgcgatttgtacaggtatgttttccccatgagtcatcactatctctgctcccagcttttctgcatactgtatatgttcttctaacttttctttatctaagacttctgattttataccagttcgtacatacaaggctgtaaaacgtgcctgcagcactttcaccattttggccgctgtatctattatttttttattggagggtgctgctgacagacaaaccagaatatgttcgcttagctctttattattctcctctgctttgaaactcatttcatcttccacccttttctgctgtttttaaaattatatcatgcgactgtgttatggtcaaaagtcttttctacctcctctgaatgtccatcaaaaatcaatattccttattccattaccatcacttattccatatcctcttcatgacaatcacgctatatacggaaacacttctgaagatcccgatactctcctaataccagtaatttattattctctgcaaaacatgtatccggagaaatcgaaatagtgaattctccttctttttttaccgccagaatattaatattgtaacgttttctaatatccagcccgcctactgtttttccaatccattcctctggtacttccacctcaaaaatcgcatgggaagcatccacctccatataatcaaggatatgatcatctgtgtaacggatagatgcccatttcgcaacttgcttttctggatagaccaccttatctgcaccgttgcgcaaaagaaatttttcctggacatcacgttccgctctggatataacaagttgtgctcccaattcctttagaagagaagttgtttcaagggaattttgaaaatcacctccaatcgtcacaaagcagatatcgtagttgccaatcccaagagatcgcagaaattcagcatttgtactgtccccaatctgggcattcgtcacaaatggcaacactttattcaccctttcttcattccagtcaaccgccataatctcatgcccaagctgattaagctgtatagcaatatgccttccaaatcttccaagtccaataatcaatatattcttcataatatttttttctccttatccaactgtaattttctctaaaggcagccttgcatttcccctgtttcttccggaaaatactgcataaatcagggtcaatccccctacacgcccaagatacatcagtataattaacacaacttgtgaaaaaacatgaagtttcggtgtaattcctaatgtcagacctactgtacctacagccgaagctgcttcatacagacagtccaaaagaggaatatcttcgtatatgctgattgcaagtccaccgcaaaaaaacaatgtaaaataaagcatggatattgttgctgcatttttaatcgcatgatattccagtctccgtccaaaagcccctgcattttcctggcttcgaaatgtagctattgcatttaaaagcagtactgtaaaagttgtcgttttcattcctcctgctgtagatcccggtgaaccgccaatcagcatcagcagtatcataaccgcacttgatgcctcactcatctctgaaatatttatagtattaaaacctgcagttcttgtagttactgattgaaatgtggcagctaacagacgctgccctgcaggcagatttttcaaatcatagacaaagaaaaaaactgccggaaggaaaatcagacatgccgtcgtcacgagaatgatcttactttgcatacgataacgtttaaagttcattttattcatatagatatcgtcccaggtgataaaaccgatcccccctataatgatcaacagcataattaccacatttacaatggcatttccagaatatctcatcagagatggaaatgtattttctgttgttcccagaatatcaaatccagcattacaaaaagcagaaactgaatggaaaactgccatccagactccctttaatccataatccgataaaaaaaccggtaacaataacatggctcctattgtttcaatcagaatggttccctttaagatgaatcttgtcagtctgacgattcctccaactttaggtgctgaaattgcatcctgtattgtacttctttgcataagagatattctttttcctgaaagaagagaaaccgctgccgccacggttactactcccaatcctcctatttgtataagcacaagaataaccgtctgaccaaacacagaccaatagcttcctgtatcctttactacaagccctgtaacacatactgccgaagtggccgtaaaaagtgcctcagaaaatggcgttggcacattctccaaagtagaaatcggaaacatcaaaaggatagtgccaaaaaggatcacacctgcaaagcccagaataatcaattgaaaagaggtcagatgcttcttacgtattatctttgacataactaattataactccttactaataattctaatgctatatcttcgtaatatattttattatatggtgttccgaagttatggaaattgcatagcaatggaacaatccggttatatctgtaagtgccaaaatttccttttgacactcacatcattatatatgattactttcaaagatagtataaaagtctatgattctgtattaagatagtataaagattttatttttaaatatgttctaattattctgccaacattctgaaagataatattatagccgcatgatttaacaaaaaatcatgtggctttatcggagaaagtattgcattgaataatgtggtgtctatttactttgtaagcttcctgttatcaaacgccagcctcatctgatgccattcaacatttccgtgtgtagatttttccgacacaccctcatccaaaaagccaaatttggcatagtatgaaaccagcttttctttacaagtcagcacaagacccttacgtccctgctgctttgcgtcatgaattgcacgacgaatcagttctcccgcatatccgtttctacgataatccggcaaagtattaactccaaaaatcatctgccatgctccgttttcgttgtgcatctctgcttttgcatacatttcatccgtcaagtcctcttcatctgtcacaaaaccatccacaaatgcaatcagtttttcagcttcatacatcagccagaaatgatttccataatatctgattctttcaataaattcttcttctgttgcagcttccgcaggtggaaaacactctgcctcaacttcggcaactgccgtgatatcttctgctgttgcatattttatattcataatttttttcctttatcaaacaatttttaacatctgaatcagcaaaatccatgcaagtccataataagtcacaaccgctaccaggtcatttaccgttgtaatcagcggaccggaagccactgccgggtctacttttattttatgaaaaaggattggcactaatgttccaaccagacttgaaataataattgctactaaaagtgagattccaacacatcctgaaatcaaaaaagcactttcaaatgaatatcctttaaataaagcaatatagattcccaaacagacaagtgccataattccaagcaatgctccattacaaaatccaactttcatttctttaaataataaatgaagtttatctttaccacttaaattttcatccatcaatactcgaatagtaacagcaagggactgagttccaacatttccggccatatcaagaattaaagactgaaagcagattacaacaggcaggactgcaacaacaccttcaaacgctcctacaactgtagaaactcccattccaagaaacagcaggataaccagccatggcagacgctttttcatactctcttttgttgtttcatttaagtcctcttctgctgacaaaccggcaagttttgcatagtcttcacccatttcatcatcaacagcttctacaacgtcctgtgcggtgatgatacctataatttttttatttttacttaaaacaggcaaagaatcttccgcatagtcctttattttttcaatactatcggaaattttttcccggtccaataaataaggatatgcataactgattaaactgtctaactcttcattttctcttgcaataatcaggtcttttaagtcaatcgcaccacaaaagcatcctttctcatcaacgacataaattgttgtaatgttatcattttctccagcctgccgaatcagttcatgcattgcctgacgaatcgtaagattctgtcggatgcaaatataattcgttgtaatcagacttccaatctcatcttcgtcataagagttaatcaaccgaatatccgtcttggtttcatcatcaatcatcggacgaagcttaaccttaacgctttcatcgatatcttcccataaatcaactgcatcatctgcatccatttcattaataatttctgccagtttatcaatgccaatctcttcaatgtattctgacggattatcaatatacgcaatgatttctgccatccattttgcatcgagtgcactatataaaagatttcgctctgctctgtttaaaaactcaaaactttgagcaatatcattttcatgataatctctaagctgttccctcatttcttctatggaaggggatactttaataatttcagcaatttctttcgcaaaaatcggttcttttaatacttcttttctcataataagcctcctctcaccctaaaaaagggcataaaaaatccatcgtaacaacttctgttacacaatcctaagatttataagttgtgaattcgttcctaacgatggattaagacttattatttatattcaatgggataaaatggcgtacttatagacacttgaaataaaatccaagtctatatccatcattatatgtacttcgacttcgactctcacaactgaccatacgactatccgcctccttttaattaaacttaaataattttttttgcgtagtgattataacacccttatttgtttggttcaagccctatttggaaactttacaaagatttatctaaatatagagccaaaaaccttataacttttttataagttatctactgtattaataacttcttctgtcttttcccattctttgataatatgcttttttatcaaaatacattctctggtccgccagaataatctgctcatcaattgaacagacttcttctgacaatgcagctccataggatatattaagtttttcaacctgtttgccatgccattttgcaactgccttttcaaaattttcattcaaaacaaataatttctcaaccgtttcttctaatattactacaaactcatctccacctgtccgatagcattttccatactttccatacacactccgaattgtagatgccgctcctcttaacagctcatctcctgatgcgtgcccaagcttatcattgacttcttttaatccatttacatcaaatatcgcaacaacaatcattttttcactcgacgcttcttttctgattctgtccagactttcctcataagcccgacgattataaagccctgtcagctcatctttgtaagcagaattaaacaaacctctgtcccgctttgcaataatatgaagactgattccaaccagcaataagcaaagaaaaaatactactacatttgctaaaatcaaaacataattattgacataagcataagtatctaaattgtgaataaccatataccagtcaaattttttcatatatttcgtaatggtataatttttactttccggatctttctcatacacataatcatcatggtcgtcttctttgattatcttctctggaagtttctgtaaaaatgaagcatatttctttgcatctccgcttcctacctgaatgtttccctgcgcatctgtaaataaaatatcgataccatactgcttttcatactttgcaatctgcttctgaatttcctccaattccatactgacaccacagactcccagaagatttccctctttatcttcaatcctcacatcaatataaatcagccacaggtccggatattcttcatctccccctaacattaccgtatactttttaccagaatctacgaatttctgataccatacatcatcctcatcattttccacatccataatcttataaaaaccatcataagtataataggctttcgttttttcagacgctacaaatacagttctataagagaaatttttcatatatgaagtcgtatactcatccatttctctgcttatttcctcagcatccatcttttcttcgttttccaacaattcaatcaaaaaatgatccgaagccagtgtattcgccacaataaccggctctaacaaccgactgttgatatcattataaattcccgccgcaatgatttcaccattcttcaatgcatgtttttgcaatacctgatacaaagataccgtcgaaataacggtactgctaacaaaacataaaacaataaccataagcatcaggagaaaaaacctgttctttttcataaaattcttcctcatattcttcccgctaaaacattacaaatattatttttattcgttttagtgagcatagtataattattttagcacactaaagagcctttgtcgaataaaaatataatgtaaaattattcaattatttgcatttttatatatttttgtataaactttcacaaaaaatgattgcataaactgcttcaactatgctataataacacaacatttaagaactattttaccaaacagcggagtaattttacttgtccgcttaactaataaaaacagaaaaataagggtgtgcctgaatttcagaagactgccaaaaaagacgcatgaaagtgcgtttcttttggcagtcttttttattttagcaaattttatttaattcaggcagaaaggagtttttcatgcttgtaatgattgataattatgattcttttgtttataatcttgcagcctactttgaggaattaaatcaggatatcaaagtcatccgaaatgacaaactgacgattgaagagttagaatccattgaaaacctggacggcatcattatctcgccgggaccgggtcgtccacaggatggcggagtctctttagatatcgtccgccattttgccggaaaacttccaatcctgggtgtatgccttggacatcagattatcggacatgcctttggcgcagtcgtaaaaagaggaaccgttccaatgcacggaaaagtaacaccgattcataccacccaaagcagaatgttttccaaccttccggaaacttatgaggtaacacgctatcattctttggtggtggacgagagttcccttcctgatgaacttcaaattgatgcaaaaaccgaggatggtgcaattatggcactttctcataagacctatccggtttatggaatccagttccatccggaagccgttttaaccaaatacggacatgaacttttaaacaattttattacaatctgtaagaaatggaggactcacgattggcagtcagattttgcaaactaaaacaatactgcccgacggcagatttattttccctttatcataccagagaaaccgcttttttagattcttctcttaccaataaatatggaaattattcgattatcggactttattcatacttaaaagcggaagaaaccgatggcatcttaaaagtaaacggaacaattcaaaaagaaagtttgttagatttcttaaatcaatatttaaaagaacacaaagaagaaaatccaaccaatttaccgatgcttggcggagctattggctatctctcttatgattacggcaggagttttgaacagattccaagccggcataaaaaaaagatttcaatgccggatgccatgtttgagttttttgatttatatctcatcgaagatttaaagaaaaaagaactgtatctttctacaagtgagcactttcatacacttgaggaatacaggagcgaaatcatgcaggatattttaacacttgcctctaaaaacgtcactgtagactctcgtctttgcgatgttagaatcaaatccgattttgtaaaacaggattatcttaatgccattgattccatgattgattatattagggcaggtgatatctatattgcaaatatgacccggcagatttctgtcgagagttcccgtaccccttatgaggtttttcgctatttaagggagcacaatccttctccatttggaagttattttaaccagccggagtttcagattgtcagtgcttctccagaacgcttcttggaagttcacgaccataaggtggaaacccgtccaattaaaggaacgagaaaacgcggaatcactcctgaagaagatttgatgttaaaagaagaactggcacaatctgaaaaagataaaagcgagcttttaatgattgtagatttggaaagaaatgatttaaaccgtgtctgcagacccggaagtgtaaaggtgactgaattatttgaagtcgaaacttatgcaacggtctttcatctggtttctacaattatcggagaactcgaaacagataaaaccgtaccggatttaattgcctctacttttcccggcggttcgattaccggtgctccgaaaatccgcgccatggaaatcattgatgaattagagcacagccaacgcggactctacaccggctctatcggatatctttctttaaatggagactgtgatttaaatattgtcatccgtactgctgtgcatcaaaatggcatttatcatcttggagttggcggtggaattaccgctgaatccgaattggaatttgaatatgacgaaacctggcagaaagccaaagccgttgtcgcagccatcgcaggaggtgacgtgcatgagtaatcttactcttacatcattaactccagatgatggttactggtttgggcttggagtatttgaaacaatatgggtgaaacaaaacactgccgtatttttagacgaacacttaaaccgtttaaaaaaatccgctctttttcttggatttctgccggataaaacatctgccagtcaatggatttcgattcggaaacaggaaattctggactatttaaaagaaaatccgacggaaaacggtgtgttaaaattaacactttcagataaaaatctttctctgacttcaagaaaaaatacttataccaaagaacagtatgaaaaaggctttgctttagactacagcaagattttaagaaacgagacttctccgtttacttatatgaagaccttaaactatgccgacaacattttagaaaaacgtctggcaaaacagcgaggatacgacgaacccattttcttaaataccaaaggcgaactgtcagagggtgcaacaaccaatctgttttttgtatcaggtaaaaaactttttacccctgcgctttcctgtggtctacttgacggtattttaagacagtatctattaaaaaactatcaagttgaagaatgtatcatcaaaccggaacaggtttctgactttgacgaaatgtttgtcaccaattccctgcttggaattatgccaatctgccgccttggcgaacacaagtttacccgacgtacgattacaaatcagttaatgcagacttactctgaaatttaaaaaagacgtcgcacttgacaggctatctttccaaatcaaaaatcaagacaaaacaagagcagacgagatttttcctcttctgctcttgtttcatcttatggtcttttcatcatcacatgattcttttctttttttccctgttccattaactgataggcttctttaaatgcctcttcaagcggaaggactccatgcactccaccaattgtaactgaaaatcgaatgtgtggatattcttctaataccatgttattaattgcttctgcaatacgctttaacttcatttcaaacatctggcttgaaatgttttccataagaagcagaaatttatcaccttcatagcgaatcaacacatcggaacaacggatacagttttctatcattttcgcgatatgataaattacaatattacctgctgcatgcccatatttctcattgataattccaaaattatctccatcaattagtgccagtgcattcatctgagtcatatttttagcatattcatcataatatctgcggttatacactccggttaaaacatctctataaaatttctgattatagtttttaattccctcaataaaatcattgcgtccaagcgggtctgaaatcatttcatcccgcattttataaatcatctcaagcacgtaaggatagccttctatttcgatgtatttcgcaatcgtctcataaatgttttcgccgataaattcaattttgctgcactgatcttttttaacagttgcctttcttgatacacaatttttgcagatttcttttttcccaaatatattataacatttatcggatttataaaccgatttcttttctcttaccggaataacttcgtacgattccacatcaatcagacgtacactatcaaatactttttctaattgctgaaccatttcttttaattctgcttttgttccttttgtgacatctttattgttgtcaaaataaatcgtatctttctcatgaatatctataattcttccaagtacaccgatatatttgggttcttcttctcttgaccacaaagactttgcgattacctgacaccatctctgtccttctggataatttgcaaggaatttcatccgaatctcagaatttaccggtgtcgtctgatgcagagctttcgtcaaagtcttgatattctcactgcctaaaaatgtttcttccccttgctccggtttaataatcacttcgcgcaatctcaacagttttgctccgtattcagaaagcgtaaccgcttcaatggcagaatcatattcaaactgaatttcttccagtcctgctgtgaaaaatttgcgtttttcctgctctttttccaaacgccaggagctgtaacttgccttttccacaattctgctgtccaaaagttcttcggttacttttgttaccaaagaaggattgacatccatctgcgcgtctatatccagactgacctcaataatatcctcaatgtcttttaagcattccaataacaatggattaaatgcaccacactgtccatctaaaatcatttccatcgctttttcttttgaaaatgctttcttatagcatcgttcacttgtcaatgcatcataaacatccgccagtgccactacctgtgcagaaatcggaatttcttctccctttaatccatccggatagccttttccatcataacgttcatggtgccatctgcagatttcataagccacactgaccagtgttttcttttgatacgttggaagttcttttaaaatggaagcccctaacatggaatgagttttcatgatttcaaattcttcttttgtcagctttccaggcttatttaaaatcttctcatctatcataatttttccgatatcatgaagcgcagaagcggtactgataatcaagacatcttcatctgtaagattataagaattcgttttattcatcagacactgaagcaataaacgagtcatggtctgtacgtgatgtacatgaggtccgctttcaccatttcgaaactctacgatatgccccagtatattaatcatcatactgttatttttttctttttcataaatctgctcttccaccatatttaacagacgtttctgtttttcataaagcattaaagtattggtaattcggcgatgaataatataactctcataaggtcgtttaatataatctgttgcaccaagttcatacgctttttccatataggaggtatcattttctgcggaaatcataataaccggtatggtatcaatccaatgcttctgattcatcactttgagtacttcaaatccatccatacccggcattacaatatcaagtaaaaccaaatcaatactggtttcatatttttgaatgacagaaagtgcttctattccatctgatgcttcaagaatctcataattctcacccagcattgcagctaacatcacacgattcagttctgaatcatctacaattaaaattgttgttgtttttcgtttttctactctatccatttactattccttcacgaatctttctctgttttcatattcaatctgacaaccacaagacttggcgcatgagttttatcgcctgaaatgaattccctttttatattttttgcaatttttgtctcgcaattattcattttcgcaagaaactcttttttctttacttttataacaaaaaacaggcagaatcgcttctgcactgcctatgtcctctagtatgatattattctatagtagattttgccagaaatcaacctctttttttgcatgttttgacaaaagactttaaaaaaaaggcagtttcctgccttttttcgtattacctttatttcacttttactttttcggttcttttgctgtaatataatatggaagtgcaacaaagattgctccgcctatcatatttccaagcgtaaccagtcctacattgtagatatatcctccaatgctgacggatgcatcacccgcattcatcaaaccaactgccagtacactcatgtttgcaatactatgttcgaatccacaaatcataaatacgaagatacaccagaaaatcataatcagttttgcagcttcagattttaatttaaatccacaccaaactgcaagacagaccagaatattacagaaaattcctctgaaaatcaactcctgtggagccaaatgcatctttgtttctgcaatctttgcatagtatgcaccaacatcaccactcggtactcctgaaatttgaaatcctactgcggaaattaaagaaccaagtaagtttccaatatagcagacaatccatactttaatggtttctccccatgaaacagaaccgccaagtgaagagcctgccataaccagattatttccggtaaacagttccgctcctgccataacaataaggcttaaggctgctgcaaaggaaaacgactgcgcacctcttaccattgcaggagcaccattgattgtcagatttgcgccccaggtaaaggtgataaatccaccgaatgcaataaataaacctgccattaaagcggaaacaaaatatcccactttatttttctctaaaaaatcagcttttgcctttccggcattacataacgttgcaaattcattcttaaacatatacgttccctctcttttcctctaatgtactctcagaatctcaataaagaccacgaaagtgcatcatatacatgttttgatacagaacacttttcctgtttgcataaaatcctacagactcacactccggattgctacctctgtgttctcacagcaaacgtacatgcctgcttttttgcaggtatcattgtgatgtcaagcggatattcgcaatccgcttcgttacttactcatatcggttaaattcaggtacggcataagccgcacctgaacctgttattttagttgaaaagaccctcacttatataaatgataagtactccacaaacttatttatgtattgaatctattaacttagaacagaccagaaatctttcctgtttcatctacatcgattctttcagcagccggtacttttggaagtcctggcatggtcatgatttcacctgtcagagctacgataaagcctgcacctgcggaaatcttcaggttacgaacagttacttcaaagtctgtcggtgcgcccagttttgtctggtcatctgttaagctgtactgagtcttagcaacacaaatcggacagttgccaaatcccattgcttcaagctgtgcagcctgtttctgagcatttgcagtcagaacaactctcttaccaccataaattttctgaacgatgttattcagtttatcttcgatgcttccctctaattcataagagaactggaagtcatttggctcttcaaccagacggattacttcttttgctaatgcaagaccgccttctccgccttttgcccatacttcagacagagcaacgttaacaccgagttctttacatttctgttctactaagtcaagttctgcttttgtatcagttgggaatgcattaatagcaactacacatggcagtttgtatacattcttgatattacttacatgttttaacaggtttggaagacctttttcaagagcttctaagttttcgttatttaagtcagcttttgcaactccgccattgtatttcagtgcacgtactgttgcaacgataacaactgcgcttggatgtaaatcagccatacgacatttgatatccaggaatttttcagcaccaaggtcagcaccgaatccagcttctgtaattgcataatcacctaattttaatgccatctttgtagcaattacggagttacatccatgagcgatgtttgcgaatggtccaccatgaacgatagccggtacatgttccagagtttgaacaaggtttggttttaaggcatcttttaacagtgcacacatagcgccttctgcatgtaaatcatgtgcagtaaccggtttctgctcagaaactttaccgtaagtgtaaccaatgataattcttcccagtctttcttttaagtctgtgatgtctcttgcaagacagagaacagccatgatttcagatgcaactgtgatatcgtatccatcttctcttggcataccgtttgtctttccgcccagaccatcaactacaaaacgaagctggcggtcattcatatccacacatcttctccatgtgatttttctaggatcgatgtttaatgcattgccctgatagatatggttatcaatcattgctgctaataagttgtttgctgcaccaattgcatggaagtcacctgtaaaatgcagattgatatcttccatcggaactacctgtgcatatccaccgcctgcggctccaccttttacaccaaataccggtccaagagatggctcacgaagtgcaaccatgacatttttgccaagtttctgcataccatctgcaagacctactgttgtagttgtcttaccttcacctgccggtgtcgggttaatcgctgtaaccagaattaattttccgtttggtttgtcagattctttcagtaaattgtagtcaatttttgctttgtacttaccgtactgctccagatatttctcttcaatccctgctttttctgcaatcgcggtaattggctccattgtgcactcctgtgcaatttcgatatcagtcttaaatcccatactaaaaaacctccttaaactaaatagagaaaagctgtccctctttttctgcttcgagtttgtttctattaaaattcacgaataatatgccgaatttttttatcagatcacacttcatgtgtaaaaaagggcaacatttgtggtctacaaatgctgcccagacggtcggcccatacttcgttttaatttcactgtggttttccacactgacccgtcagaaatcaaaactgcttttcaattgatatctataatctaccataaaccttatagtttgtcaatgctctaacaaactaaattgtgtattttttttgttttttcagattaaatcggcgcattatttattttgttgaaataaatgtttcgacatcttcttttgttggcattacacgaagtgcgccttttttggttgtaattaaagatgacgctccatttgcaaattccagcatttcatagagttgttcttccgataaaccggtaattccattctctaacacatagtttaaagcacaagctccaaaggtatcacctgctcctgttgtctcgattgtattttcctgaagaaacggcgcatgaaagacttcttttccctcatgaaatgcaatacttccttcttttcccattgtcacattcatcagtttcagattcggataatcagcaagcagtttatatgcaccttctttgatatcttttgttccggtcataaattccagttcttcttcagaaatctttaacaaatcacactgtcccagtccataggcaatctgttctttcgcaagctccatgctgctccataatggtggtcttaaattcgggtcaaaagaaatcaacattccggcctcttttgcaatagttatcgctttttgggttgcttttctgacttcttcatgtgtcatagacaatgttccaaaatgaaatgcctttgcagattccagatattctttctctacctgagattcacttaacatcatgtctgctcctggattacgatagaatgcaaaatctctgtcaccgtcttcaaatgtatgtacaaaagccagagttgtgtgaacttcctgattttcgtacagatgactggtatcaattttcaattcatttaatgtttttctaagagaagtaccaaactgatcttttccaactacacccagaaatgaagttttctttccaaggttatttaacatcgccagtacgttacaaggtgctccgcctggatttgcttcaaaaatcggatttccctgagcactgactccattttcggtaaaatcaatcaacaactcgccaagtgcaattacatcaaactttttttccatgtcgtttcctcactttattttttattgtttcactttgttatttcatacctgttggggctgttttttgccccaatcaatgttgatactcttattatatcggtattggttttagactgcaatcactaactatatctattacaaaatatctacataagatacattcagaaactactcttaatctttccattattcttccgttgtacgagcccatcttacaaagtcccgaaacagattcctaatgttctttaacattccgtcaaaaactcctgctttataaaaattaatcacaatcgcacctatcggcactgcaagtatcattcccaatacactgctgattttatatccggtatacataaaaatcaatgtcaccagcggattcattcctatcgaatctcccaccatcttcggctcaataattctgcggacaagctgtgtcaccagatataaaatgacaagtcccaccgcaaaactggtatcaccggaaagtgctttaaaaatcgcccatggaatcaatgcagttccagttccaaaaaacggcagcatatctaaaaaggaaaccagaaaagaaatcaaaattgcaaattttactcttaaaatcagcattcctataaacaaaatcagccatatgactcccataattttaaactgtgccttaaaatatccactaaacacctttttgaaactctcagcgagcatccgccatttatcctgtatcattttcggagtgtgttttcgtccaaattccagaattcgatttctgtcagcaatgaaaaaatacgacgacaacaacgtaaaaatggtagaaatcaatgcatttggtaaattttttgcaatatttcctgcataatctacggtaagttcgcttaccgtactgattatcgtaccaatttcctttcccaattcttcctgcgtattatcgatactcacctgcacattatccggaagttctttgatgatgcttcttaaattatgctctacttcctgaaattcttcgctgaagccgctatacaaattcggagcctgctccagaaattttccggtttctgtcattacctttgcacctatgagataacttccgccaatgattgcccccaaaaccataataataatcaccatggaggtatgtttccttgatatctttaattttttttccaaaaattccaccagaggacttgctatcattgcaagaatccacccaataataaacggaagaaaaaatttaaacatttttattcctaaaataatacagagaattcccgtaatcagtcctaaaattgctaaaaaaactccctttaaatgttttttcaatgtttttttcataaattaattttccttcatttgataagatttttttaaatttcttttaaaaattcaaatggctctccatcatgaagaaaatgcatcagcatataggacgtcatgatggccaccttttcttcttttaaaatccgttttacttcttctttatctgcaagcacaatctccagttcttctgaatcttccagtccggctcttgacacagttccggatgcatatccataaaccgttgcacaggattcatcggtcattccgattgtcgtaaaatacggtttttcataagccggatttaccgttaccggttctaatgtcaatccggtttcttctttcatctctctgattcctgctgttttaaaatcctctcctgtctctaccagtcctgccggaaattcatagatataatcatcaattgcataacggtattgtctgactaaaacaactttattcttatcctctttacagactgcatagataattactccatccggatggttttctcttgtattcaactttaaatgtctctcatcttttgctcttgatgctacataataatgacctgcttttcctgttttactttctacatccagatgatacaaacgaacatatggattttctgtcatcggagttacttttttaatggatggcatacttttttacccctttctgatgcaattgtgcaatttctgcttttgtaaatagaaagattatagcgcgtttacacttgtttttcaagacatagccgacgatctaaacaacaaaaaagatatctttcgtttttatccgaaagatatctcttttgttcatctatttattctttttaatttataagacagaaattatctctgaacacgtgctcctgcaccgcccatgattgcttctacttcttttttgcttgccattgttgtatctcctggtgttgtcatggcaagtgcaccgtgagctgctccgtagtttacagccagttctgcattctctgttgtcataagaccatagatcagaccggatgcaaaggagtctccgccacctacacggtccataatttcaagacctttgtagtctttggatttgtagatttcaccatcagcccagcaaattgctgcccagtcatttacagttgcagtcttaacagtacgaagagtagttgctactgctttaaagtttggatatgtttttgcagcttcgttaatcattttcttgtatccgtcaaggttcagttcttttaagttttcgtcgtttccttcgatttcgaaaccaaggcaagctgtgaagtcttcttcgttaccaatcataacgtctacatatttagcgatttctttatttacttcctgagcctttgcctgtccaccgattgcactccacatagatggacggtagtttaagtcgtaagatacgattgttccgtattttttagcagctttgattgcagctaaaacagtttcacaggattgttcagataaagcagcgtagataccgcctgtgtgtaaccaacgtgctccgagttccccgaagatgtaatcgaaatcaaaatcttccggtgttgctttagaaatagctgtatttgcacggtctgagcatccaactgctccacggataccaaatcctctttctgtgaagtttaatccgtttctgcagattcttccgattccatctgttttcatccatttaattaaggaagtatctactccaccctgattgatgaagtcttccattaacataccaacttcgttatcagcgaatgctgtgatgatacctgtattcattttaaagcatttgctcagtccacgggcaacattatattctccgccgccttcccatgcacggaagcttcttgctgtacggattcttccttcgcccggatcaagacgaagcattacttcacccagagatacttcatcaaatttacactcacttgctggtcttaaatttaaattcatgattaatcctccaaatttttatgtattgtcttacaattttgctcttatcatttcactcttacaattttgctcttgcaatttcttattatagcatgtggtttttatttttgttgttttttctttcgtgctttccaactttttaaaattctaagtaagcacctttcatcgggcttgctgcatgttcactgaacagacgaagcacaccatttttgtattttacttcttttggtttccagtttttcttacgttctgcaagcactttatcgatttcttccggagttttttcttcccctgcgataccgatgatatttaatttacgtgcaaatacatcaatttcaattaagtcaccttcttctactaatgcaatcggaccgccttcggctgcttccggactgcagtgtccgattacaggaccggtagatgcaccggaaaaacgtccgtctgtaatcagtgcaatactttttccaagttctttatcactgctgatcgcctctgaagtatagaacatttccggcataccgcttccttttggtccttcatagcggataaatacagcgtcacctttgtttactttatgttttaaaaccgcatcaagacattcttcttcgctgtcaaatggttttgcacgaagtacggcacgatacatttctttcgggcatgcagtgtgtttgataactgcgccttccggtgcaagatttccacgtaagactgcgatacttccgtctgttccaattgctttgtcataaggacggataacatcttcttttgtcacattgcagccataacgtttgttaaattcctgcatccatttgtcgcatctttcgtagaatccgtttttctttaattcttccagattttctccaagtgtttttcctgttacagtcataacatcaagatgtaagtgctgtttgatttcttccataatagccggaactccgcctgcatagtagaaacattctgccggccagcgtcctgccggacgtacatctaagagatatcttgcatttctgtgcagtctgtcgaaggtatcacctgtaatttcaattccgagttcgtgtgcgattgccggaatatgaagcagacaatttgtacttcctgaaattgctgcatgaactaagattgcattttcaaagctgtccattgtcacgatgtcgcttggacgcatgttgtccatttttgcaagtgcaactgcctgacgacctgcctgtcttgcaaaatcaagtaagtcaggactggttgccggcattaaagcagtacccggaagtgcaagtccaagtgcttctgccataatctgcatcgtagatgcagtaccgatgaaagaacatgctccacagcttgggcatgcattgtgttttgcccagtttaatttatcttcatcaatttctccgcgctggaattttgcactatacatacctaactgttccagagtcagcatgtccggtcctgcattcattgttccacctggcactacgatagccggaatatttaaacggcacagccccattaagtttgccggcattcctttatcacagcttgcaagaaatacgcctgcatcagatacagttgcatttccgtggatttcaatcatatttgtaatcatttcacgacttgcaagagagaagttaattccgtctgttccctgactttctccatcacagatatcggtacaataatatcttgctccaaatccgcctgcttctgcaacaccctttcttacttcttctactaagacatttaaatgtccgcttcccggatggctgtctccgtaagtactttcgattaaaatctgaggtttggataaatcctccggtttccatcctgtaccaatacgcagtgggtcaagctctggtgctaatgtacgcatttcctggctttttaaacaactcatgttttttgttcctccttaaattttaaattcttagtttctacttattttattttttatttttactttatggacttttctattactatttattaactatttaactaaatatcctccgtcaaccggaatgactgctccacacagataatcacttgcatgggaagctaagaaaatggctgttccctgcatatcctctccggttccccagcgtcctgccggaattctttcgctgatagttttaaaacgtggatttttcgggtcaagaagtgcttcattcatttctgttgccatatatcccggtgcaattgcattgacattaattcctcttcctgcccagtcattcgataactctttggtaagctgtgctactccgccttttgcagctgcataggccggaatggtctgtcctccaaagaaagagttcatggaagcgacattaataatctttccatagcctttcttcagcataatttttcctgcttcctgacacagtacaaaaatagaacttaagttgacgctgattacatcatcccattcatttaatggaaactcttctgcgctatgacgtctctgaattccatgtgaagtaacaagtacatctaagtctccaccaagtttttcgacgcattcattgaaaatgcggtaaacttcttctcgtttggaaaggtcaccctttatgcctacacagtcataacccttgttacattcttcttccgctacagcaaacaccttgtctgatgttccaacaattgccactttgcatccggcttgcaaaaagccctctgccattccaagacccagtcctcttgttccacctgttacaataactttctttccagaaacatcaaataaattctgtcccattggttttttccacctttctcctggtttttaagtcgtcatacgtcgtatctgtttttatggtatcacactccaatttcacggtcaagttcttcttttgatttcgttttatttcagcagattttataaaaaggcagaaggaaatttgtaagtatttcctcctgccttttttatatcttcttagaatttatgtcttctcagaatctttcttattccatctttttcattaataatttaatttgaatcctgttattttccaaatgacgcttcattgcttcacttgctccctctgggtcatgccttttaattgcttccagcacttcacggtgagtcacaattgttttatttgcaatcgaataatctgtcacatcaataaacagagaaattccactttggattacaggcattagattggttgtcacctgatttccggtcgcccttgcaatctccgcatgaaataagatatctttttccagataaggctttccctgattgaaaagttcctctacttcttttgcatactcttcaatcttctctacctgttctcttgttgcacgcagtgctgccagagccgcaatctccggttcaatcatcatacgcacttcacaaatatccagggcaagactcttcttatcctccataaatgcaaatccaagagggtcatccatcagccccggtgtctcacttacgaaggttccacgacctctttttatttccacaacatttcttgataccagtatttttactgcctcacgaatggttccacgtccgacattcaactgctctgccatttcaaattcatttggaagtttttctccggcttttaatttccggtctgaaatcagttggacaatctgttctgaaactttttccggcagaagtttattgtttgaatcgattgatttcagctttctgccctcagctttttttcccatactccacctcaatctttcctttttcttatttttcggatgttcctgatgcagagccgctcattgatgtttgatttttttctgctttctaatttaatatccgaacttcttctcagatattatagtataccagtaatttcctgtaatttcaataaatttgcaattttcgctttctgttcttctgttgcacaaagcagaggctgggcgcagaccggattaaactctactccggtctgtaccattgcttctttgataatcggaataaactgttctccgattgaataaatttccatcaaagaatcaatcttctgctgacactctgccatctttacaagattatcttctcttgctgcatttgcaaatgcggaagcaatctgcggtacaaaatttgaaattccggctacacagccatttccgccacttaatacattatgtgcgaaaaattcatcaaatccggaatatacctggaaatccgggaattcttttttcacaacctgaataatctctcttgtgtgacccattgttccaacagtatctttaattcccacgatatttttatgttttcttactaattcaagaattaactgcgggcttaaatcataaccggtacggtccgggaagttgtataataagaccggaccatttacattgtctgccacctggtcataaaagttaataacagaatcatgtggaagattaaagtaatatggtgaaattaccataactgcatctgcacctttttcgattgcatagtttgacaattcaatacaatcttttaaaatcatgcagtttgttcccacatataaagtcacacgtttgttgatgtaagaaactgcggtgtcaatcagttttttcttttcttccatagaaatggcgaagaactcaccgatacttccaaggatgaggattccatccataccaccctgaattaaatgttcataaattcttttgtttgcttctaaatctacatgtccctcagcgtcaaaagctgttacaacaggggtaatccattttgcgttcatatctcttctcctttaattctagtatcctgcaccttccattgcggaacgagctgattctgtatatctcttaaacaaaccttttcttggcggtcttggaacgattccatttttactgcgctcttttaagactgcgtctacttcttctttggaaagttcttttccattaattccaaccacatccaaagtacgttccggaatattataagaaataatatctccggtttcaataaatgccaacggtccgccacttgcagcttccggtgatacatgtccgattgccgcacctcttgttgcaccggagaatcttccatctgttacaagagaaacttttccatttaatttggtatcgcacacaattgcctctgtagtcatcagcatttccggcataccactccctcttggtccttcataacggacaacaattacatctcccggttcaatttttccatcaacaactgcctgataagcatcttcttcacgattatacacttttgcggttcctttgtgaatccgcatatctttttcacaggcagagtattttacaacggaaccttccggtgctaaattcccacgcagaattgcaatcgaacctttttctgttgccttttcgaccgggaaaatgacttcatctctggttaatccatagttgcttaaataaccaagatttctctcaaagaaattatctttttctaaatcttcgagattttcacccagtgtttttccggttacggtcattacatccagatgtaacatgtcttttaagtatttctgtaccatcggaattccacctgcaaaccagaaagattccgtcatctgagttccgcttgggaagatatttccgatatgcggcactttatgattgatttcatcaaagagctctggtgtcagttcaattccaagttctcttgcgattgccggcagatgtaaagttgcattggtagaaccaccgattgcactatgtacgatgattgcattttcaaatgcttctttggttaaaatcttagacggtgtaattcctttttctaccagttccataattttacgtcctgccagacgggcataagaaagaatgtctcgcatggtagccggaatgactgcggttcccggaagcgccattccaagtgcctctgccacacattgcatggtgcttgctgttccaagaaaagcacaggcaccgcaggatggacatcctgtcattttataatcacggacttcctgctctgtgattgcctcttttcgtttctgacgaagagaaatatctccagcaacaagagaagttgtcatatttggacctggacgcatactgcctcctggaataaaaatagtcggaatatccagacgggcagccgcttttaaatgtgccggtatggatttatcacaggaagaagataaaatcattccatcccatggatacacacttccgtgtacttctaccatgtcacagattgcctctctggatgccagaatatagttcatgccatcatgtccttgtgcacatccatcacagatatctgttgtatgatactgtgccggatatccacctttttcaaacacgccatattttgcctgttccataagacccgccagatgagtacttcctggatggctgtctccaaacacatcttcgagcataatctgtggtttcttaatgtcttcttcatcccagcctgaacccatctgcagggcatcaaactgtgcccataacagacgctgtggtgcacttttttgttgcatttttttatcctcctgaatttttttctttttatcttatcatacaaaattttaaagttgaaatccactttaattgaaaccaattttccgcaatatgtgaacggttaagttttttatttcttatggctttcttataacaaaattcatacaaaatgtaaactaaaacaaaaagggcaaagaacccttttcgattctttgcccagtttcatatctcactttagttcgatttgaatttttgatttaacttacatcaatcctggtaagaatccctggaagagagaaaggattgatacaaaaatcagaattgcaacaccggctacgaaaccaccgatactccatcctctgattgtatccggtacggagattccgaagaaacggctgattgcccagaatccggagtcgtttggcatggaaagaccaataccaccggcacagatagcaatcgcacacagaatcggagatactccggatgtagcaattgtaccagccatgatagctgctgttgttgtaagggctacagttgtagaaccctgtgcacaacgaataatctggcagattacgaagcacagtaccagaatcggaatactgaatccggaaagtgttcctgcgatataatctgcaatacctgttgcctgaagaattttaccaaaagcaccgccggcacctgtgataagaagaatcagaccaacctggtcagcaccttctgacataattgttgtgatagattttgtcagatattttctggaaactaatgcggcatataaaacaccgactaacatagcaaagtttttattaccaatgaaggaaacaaacggtatttcttttcctgctgctaacggaacgaaacttccaagaagaatcaggataatcggtactaacagaatagacagggcttttaacgctcccattctttcttttcctgttgtatctcccatagatgcagcttcttcatctaaatcatcaaatgtatagaaatgtttgtttttctggtcctgtttgttgatgaatccaccataaacaataccacctacaatcatacctacaaatgcagatactaatgcgtagaagaagaaaataccaatttcaattccaagttcctctgcaactgcaagtggtggtgcagtcggcagtaccagtgcgaatgtacatgttgtagctactgaaattgcacatgcgaaagtaaccatggaaatttttgttttcttgcataatactttcagcatcggagcaaacatgatataaactacatctccgaataccggaatacctgtgataaatcctgaaatagcaactgcgattggagattttttatcgccaaaagcttttaagactttatttgcgatagactcaataccgccagcctcatacatgaatttacctaacataacaccaagaccggtaaccataccgattccaccaagtgtacctccaaatccgtctgtaacggtctgggcaatctcaccaagtggcatgttcgcaaccacacctgtaatgtagccagtgagcagtaatgctacgaaagcgtttacctgaaatttgataatgagtaacagcagaattgcaattgcaaggataaagattgcaaccaatgccggacctgttacgattcctcctgaaaacataccgttttcctccctttttcttttttcaatgcaccctcagagcacatcttatttggttttcatgtgacgtgtgacgtcgtatccattccatgagtagactgtaccagattttatacaaatagtcaatagggcattgtacattctgtgagttttagataattttaaagtttattttttggtaaattttcacataacttttttgtatgttttttcttcatttttatttatctcttttttttaaaattaaatgccgaaatactccggatagtgttccagaatattctggaaattttttctgtaaatcccaagatgtctgtcatagaattttttcaggtcaaagtcctctgtgtagccgattaacagctgatgaaaaattttttcatgttctttctgaattgcttccaaatccgttttactcataattgcatcgagataacgaacacggtcataatgggaactgactcttctgactgctctccagacattacttttatttcctgcctgataaattaactgatgaaatttattgtctaatttaaaaaacgcatcaatactgtcttcatttttttcttccagtacttttttctgcaaatccagattttcttttattttttccacgtaatcctgacttaacgaacctgcaagcgttgcaagaatttccggttctaagaccgaacgcataaaatagccttcttttaacgtattaatgttaatataagaaactttagaaccgctctgtggatacacttctaccaacatctcttcttttaacataatgactgcttcatgtaccggtgtccgactcacatgaaaaatttctgcaagctctgcctcatttaacgtttctcccggaagcaactgcatggtcataatattatctcgaagcactcgataggcatactctctattgttttctttttttcttcgttcgctgattcttaacttcatatttttagttttccccttttctcgtcttttactaatatattagtttagttctttttcttttttactctgcttttattttactatccctctgcctgtcacgtcaatttttttcgagcattttcccctgtatttccttgtatttttcacgtttttgtatattttttacagtttttcattttaattcttggcaaaatttatagttgcatcttcggttctgttctgatatattaatggcagatgcaactgatatatcagttttcatccattatcagaagatgtatccattccttttctcttctggtttctgatattcagattgcaaagagaaccagtaaaaagcaaaaagtaaaagtgctccactttccggagcaaaaggagataaaatcatgaaagcaattaaagtaatcgaaccattcaaagtagaaatcgttgacgtaccaaacccaactatcaaaaaagacgatgatgttatcgtaagaatcacttccggcggtatctgtggttctgatatcggaatctggaacggaacaaactctttagctacttatcctcgtctgattggtcatgaatttggcggtatcgttacagaagttggttctgctgttacttctgtaaaacctggtgacaaagttgcagttgacccggttgtaagctgtggacactgctatgcatgccgtatcggaagacacaatgtctgctccacacttgaagttatgggtgttcacagagacggtggtttcgctgaatttgttgttgctgatgagaaaaacattcataaattccataaagactttgacgaatctttactcggtctggttgaaccatttacaatcggtgtagaaatcaacaaccgtggacagattacaaaaggcgataaagtcctgattatgggttctggcccaatcggtatcgctgcaatgcaggttgcaaaaagaaacggtgcagaagttatcatgactgaccttgtaaaagaacgtctggaaaaagcaaaatctatgggagctgatgaaactgtattagtttctgaagataacttagaacagcgtctgttagacttcacagatggagaaggtattccggttgttgttgatactgtatgtattccttcttcctttgaacaggctgtacagcttgcatgccctgccggacgtatcgtctgcatcggtctgaaaaaccagccatcttctatcacaatggctgatatcacaaagaaagaactgactatcgtaggttctcgtctgaataacaactgcttcgatgaagttatcgcaggatttgaagatggaactctgcatccagaacagttaatgacaaaagcttacaactacaaagacgttatggacgcattaaatatgattaaagaacatccacaggatgtattaaaacttgttttaaaatttgaagattaattaattttgctactcccccttaaagtgatatgtgctctcggaagctttctgtaaaaactccgagagtacattaataaaacaaaaccctcttatgattctggtgcaccatgaaagtggtgcaccatttaagactaagccaaaattttagtaacccaataataaactataaaaaaagcgaaaggatttttgattatgaaagaaatttatatcaccaacaaagaatccggaatttccatggacgaaatctccaaagcaatggacaaacttctctctcagtatccaaatctcaaaaaagtattgattatcccgcctgattttacccgctgttactcttacgccggcgaaatttcacagattttatataaaaaacttgctccagaagcagaagttcatgtaatgccggcacttggaactcacatggaaatggacgaagaagaaaaacaaaaaatgtttgcaggcgtgattccgaatgaagcatttttagtacatcactggcagaaagataccatttctatcggtacggttccaaaagaagtcattgaagaaatctctgaaggcttatactctactgatatcgaagtggaagtcaatgaaaaactgattcacggcggatatgatttaatcctctctgttggacaggtggttcctcatgaagtagttggtatggcaaactacagcaagaatcttttcgttggagtcggcggacgccagatgattaacaaatcccacatgttaagtgccatctgtggtatggaaaaagctctcggtgttgcagattcaccggcacgaaaagtatttgactatgcacagcagcatttccttgacggaaaacttccgctggtttatattcagactgttacaactttaaatgatgatgatttgaaattaaacggtttatacgttggttcttccagaaaaccatttgaaaaagcagtggaactttccacagaattaaacattgtccatgtagaacgcagagcgaaaaaattagtgacttaccttgacccggatgaattaaagacaacatgggttggaaataaaggaatttaccgtaccagaatggcagttgcagatggtggagacttaattattcttgctcctggtgtaaaagccttcggtgaaaatgaagaaatggataagatgactcgtaaatacggttataaaggacgtgactacgtgcttgatttatttaacaaaggtgcatttgacaataagattatgtctgctgcacacttaattcagggttcttccgacggacgtttcactattacttactgcaccaaaccggaaaatctctccaaagaagaaatcaacagtgttggctacgaatggatggattacaatgaagcagcttctttatacaatccagacaccttaaaagaaggctggaatactcttgaaaatggagaagaaatttacttcgtaaaaactccggcacttggactttggaaagtagattgatttttattctaatttaaaactcccccatattttctctcttgagaatatgggggagtttttagtttatcttattaaatttcaaataagaattaagcctgaggacctgcagaaacaagtgctttaccagcttcgtttccttcgtatttagcaaagttcttaacgaatctgccagcaagatcttttgcttttgtttcccattcggaagcatctgcataagtgtcacgtgggtcaagaattcctgtatcaacacctttaagttctgttggaacttcaaagtcgaagaatggaattttcttagtcggtacatttaagatatctccgttgaggattgcatcgatgataccacgagtatctttaatggagatacgttttccggtaccgttccatcctgtgttaacgaggtaagcttttgctccgctctgttccattttcttaaccagttcttctgcatattttgtcggatgtaattccaggaatgcctgtccgaagcaagcagagaaggtaggtgttggttctgtgataccacgttctgtaccagctaatttagctgtgaatccagacaggaagtagtactgtgtctgttccggtgtcaggatagatactggaggaagtactccgaaagcatctgctgacaggaagattacgttcttagctgccggtgcagaagataccggacgaacgatgttttcaatgtggttgattggataagatacacgtgtattttctgttacactcttatctgcgaagtcgatttttccatctttgtccagagttacgttctcaagaagagcgtcacgtctgattgcattgtagatgtccggttcagattctttatccaggttgataacttttgcgtagcatccaccttcaaagttaaatactccgttgtcatcccaaccgtgttcgtcatcaccgattaagagacgtttcgggtctgtagacagagttgttttacctgttccagaaaggccaaagaagattgctgtgttttcaccatttaagtctgtatttgcagagcagtgcatggaagcaattccttttaatggcaggaagtagttcatcatagagaacataccttttttcatttctccgccgtaccatgtgtttacgataacctgttctttgcttgtaatattgaacattacagctgtttcagagtttaatcctaattctttgtagttttcaacttttgctttagatgcgttgtaaacgatgaagtctggctcgaatacttccagttcttcagctgttggtttgatgaacatgtttgttacgaaatgtgcctgccaagctacttcaacgatgaaacggatagccatacgagtatctttgtttgcaccgcagaatgcatctactacataaagttttttgttagaaagctctttgatagcgatatcttttacagtatcccaagcttcttttgtagctgggtggttgtcgtttttgtactcatcagaagtccaccatacagtatcttttgagttttcatccataacgataaatttgtctttaggagaacgtcctgtgtaaacacctgtcataacgttgacagcgcccagttcactttcctgacctttatcgaatccttccagttccggttttgtttcttcagcgaataatgtttcgtaagaaggattgtatacgatttctgttgttcctgtaatgccatacttagttaaattgatttctgccatctttacacttactccttttctttcattcctctggaagtgaattttctcacttcccacttagtattatacatgatatctaaataaaatccattaaaatttttataaaattttttattttttctatctttcacaattattcgacgtcagacgtccttttctatggtaaattaatacagttttgctaagataaatcttcttttgctccctttgttttccattttttatgttgttttgatttcctgtacacacaaaaaggatgtcctttactctcccaaataaatgacatccttttttatacccttttttcgatatcaatatccctttttatcccctacaggaggcctcgctttcccgcttccattacagcttctgctttatttgagactcccagcctcttataaatctgctgcgtatggtattttacgttactcaccgacatatttaaccgttctgcgattttctctttagaaagaccatctgcctgaagcttcagaacttccagcattgcatcacttaacgtaacgctctcgattcccgccttcaaatatcccggataatagcgggtcattttttccgtttcttccaaaacctgcttccagaactgccggttctttttttccccttcttttgattctaccctcgaaggttcccatctgctttgcgtaagcaatgggcggattgcagctccctcacgtgtaataatccgcacaaaatgatattcctctgccatttttaatccttcacacagagtctcatcccaccgttcatccccaatacggtactgtacaatcgccatcaataatttcacttcgattttgatataaatgcgtttcattactgttgcatagtactcacattttaaaagcagattgtacgcctgttcatttctcccattttgcagatacacacgtacttttgtcagataatgaaatctgtcataaattgaaaactcctgttcttcatccggtgctttcttcatccatttctcaatctctgcttttttctggctgtagagcgcacatcgtataataaaggtttcaatattcggaagcaggcgttctgcttcttctttttctgcttttttatagaaccgttttaacagttcttctgcctccgatacctttcctgtaataatatgcagccatgccagcatgccgtctgccacaaagcattgttctaattttcctccggtctctgcctgcattctccccttattggctaaggaagcgacctcatagttgtcctcacccttctcaaaaaagctttctgaaagagccagatttaccataccctttccatatttcccaaggataaattcaaccagttttccaatgccttttgccagttctctgtctctcttgctccactcacagaagtcctttccgccattcatctgagatgcctgattactggtgacagaaaattcctggagactgacctgcttatccaagattaacagatgtgcctttttcagaatttctatcatattctcactgcctctgtgcggaagtccgatttccagatacagtaattcacttctcgccctacgccgctcccttccggaatgttcctttgcatactgttccaattcctgataccagtgttcactctcttctatatccaataaaagtgactgaagcatgctcattcccatcataagctccggactggtacggattttttcgtctgaaagcttcaggtaatattttttcagctgataataataaccattatttggtgcagttctcgcattttctatcagcaaagacgcaatccgctctttctcccctgctttttgatacatctcaagcgcacgaattggttctttatttagctgataatacaagcctgcattttcataaagggcatgtatctgctctttattatactttcgtttcagacgtctgcgcatactgatacacatttcccgacgaaattcatacacaacttcgtctttttctgttctttccatcataaagtttccgagccattttaccctgcttaaaattgattctacattatttatccccgtaatcatctctgccagatgtgctgtaaaacaatctacaatcgaaacttccattaaaaattcctgtattcggatatcccagttgtcatagacatgccagtcaagataatcccacatctgggataaccccctgtcaatcagctctgaaaataatttatccgaaaaatactcgccctcttttagtccctcacgaagctgaatctgcttatatatatcccatgtaatataccagccaagcggaacccccaaacagtaatttctacttaccttgcgctgttccggcgtcaacagtatctttgtatattctatgtattgattttcctgagcttcatcaaacaataattcagactcttctatcacataaaagacttcgcggtaacggacagcagcaagccacggtggtacggcacatctccccgataaaatcagccatacatcttcccgttcaatcaacgaaataattgcttctttgatatcttcacattcttcctccattgccaaatcatgcagattatcaattaccacaatctttcgtttttcagattctgcaatcccctccagttcttctgcgcttacccttccagcatcaaacatctgatattttttctgttttaaataacggacaatcagttctgtcttaccaataccgctcactccgtaaatataagcagttatattttcttcttcggcagccttcaaacgcctgagtgcccgttttggccggatataacatattttgtccttttctgtcaatgatacacccctcttcctttttcctttctatacatagaattataacaattttcgacatctttgtatactaaccaaacggctagtattttcaaaaaaacgcagattatttgaacgcagataagcattcccctgcttcaagtgcgcaaagcactaagcagcgggtaaggggggatgcttatgtcagcgggagttgaaaactcccactgacagattgcgaagcaactgcgttcatgagcaagtagcgaagcggattgcgaatgtccgctttacttacatgaagctctgtgttacctgaaatttctgcacggatgtttttgtcaaaaaattttacataaatttttcatttctgcgcctgcatactttacaaatgatttctaaaataacagtaacgaaacagaaaaagaatttttttatttttattcattaatttagaaacgggggatgacacatgtatcagaaattatggaactttacaaaaaaacataccaggaaaacgcacaccgcttttctttttctcttcactcttattaccggatggagcattgtcggacttgttatcggcacacttttatgcctgacaactgctatgagccttccggttcaactcaccgtacttttatgcaccaccggatatgccggactgattcccggattctttgccggaatcttctttctttacaaattgaatctgaaacgtcctgccggattaacgtatcattctaattcagaggagcgcacaataaagctgctataaaagtgaattctttttgttaccgcaaccgtaggataatcccattctccatttttttaactatggtaaaatagatgccccatgcaataaatgccaaaaagagaatcaacaacccctctccagcattgttgattctctttctttcatgcctaaacttaaagcctagaaaaaacgcacattatttatttcactcatctaactcaaaaatcttattatttactagttcatatttgccgccatccatatttttacgaacaaacggcactccttttcttacataaaacacattctcttcaatcaaagcatccggattctcagaaggactaatcgtcccccctaaatcatcaaagctttcatttttacggaaggtattatgaattgcctcctgcaagcagaacatcacgcagccgccttcattttgtctactatagttatactcatagattgtgccatcccctgaatctgcatcatatgccatgccatcctggttcaatctcgtatcagcgacttcgttatagcgaaagagcgcatctttacacttccaaggccagattcctgctgctacctttcctgctttatctcctggattgcaataaatccgatcattcatctcacacgcaatcgaatctgccatattatgctctaccagcggacgcagcgcatacattgctgtaattccgtctcctcctgccgctttcacataattatcgcaaatcttcatattttcatgtccatacttcaagaacgtttcttcgtcaagctctgccccctgaaacttttcatgtgcatacgtgtagcctactgcaatcccccaacggctcacctgatacacaaaacaaccctcaacggtaacatcctgataacgtgccacacccgtagtctcttcacattttggacgaagcgctgtcatgtaaattccaccattattcatgtgtttatcatacacattgccatgcacatcatgaatcagcagattacgcagcgtaattccgtgccgcacccctttatcttttgccacaactgcaaccccggtgcgattcattttgtctccaagtgaatactgctctccgatgatctcgcttgcctcatttgtaatttccaaatcttccacaataatatattctgcatcatacagtaaaactgcggacgatacatatccgtgatacacatgtgtcggtgcatccaacggatttccataatcctgataccagattccctgtccacatgcttcaatccgaggtggttctccatcgccgtataccccaatcacaatcggcgcttctttactgccactatcagtaatatgaaggtactgtccataaaatacgctgccacgctccagcaatacacggtctcccggtttgaggctgctatgattgattgcaaaaagactggcaaatgccgtttcgcaatttaatccgtcgttcgaatcattccccctcttcgaactcacgtaatacgttttcgataagcttgtcatacgcatcctcccgtaaccgtttttcaataatctgtgcaacttcttcatacgtaaagaaatcaccatgatagcgtccgaataaatccatattttgttcgtaaaatgctcgcttttctgcttctgtaaactccggacataagccagttttgcgaactgcctcacttggctgcacaaaatctaatttcaggcgtgtcaactcatactgcagataggccggagctgaaaaataatgcggtccatagaacttcttattctcctgctccagttttttcagcatcctattatgcgcctgtcgccttgcctcgaatccttccatagaaggtgtttccaataatccaagtttgtgtgccaaaaggaaggctccctgcgccttccttaaacactcctgtttgatacaataactctgtcgcattattttaccgctcctgtaattccatttgcaaaactcttctgtaagcataagaagatcactgctgttgggagtgtacaaattaatacgccaagcatcagcataccatagtcaacgctgtaaccactctttaagtttgcaacgagcattggcattgtgattgctttgctatcctgtaaaataacagttggccataagtagttattccatgcactcatgaaagttactgtcatggctgctccataagtagatttcataaccggaataaacattttgaaaaaaatctgaacttcacttaacccttccagtctcgctgcctcgataatatcatgcgggaatgaacgcgccgcctgacgaaacagcataatcatgaatggagtagagattgacggaagtgcaagcgcaatccaggtatttaccaatccccatgaagtaaacattttaaataatggaatcataattgctacgaacggaagcatcatcgcaagcagcaaaatgctcattaaaatatctttgcctttatcatggtagatttcgaagccgtatccggcaatggagcacacaagtaatgctacaaatgtaatgataattgcattacggaatgagttaaacatcgcaagtttcagattctgcatcccaactaaggttttaaagttttctaccagataaccacctggaaccaaacgtcctcttaccacatcaatacttgtattggttgctccacagagcatgtaatacaacggaaatgcagataaaaagcttgcaagaattaagataatgtatgaaattactttttttgtcttagtcacgtttgtcacctactttcatctgaatcgcagacaggattgccaccattataagaataaatacagataatgccgctgcatagttaaatttcggtgtctctacaaaggaaatattgtaaatataatgtgccagtgtcattgttgacttacctggaccaccgcctgtcaagttcatagattcatcaaataactgtaatgttccggatgttgacataattgcagtcataagaatcgttggtttcaaaagcggaaccgtaatctttataaactgcttgaacggagtcgctccatcaatataacttgcttcatatacagagtaatcaatattctgtaaaccggcaagatagaataccatgttgtaaccggtccatctccaaatcaaagcgattatgattacccaacgtgccggccatgtactctggaaccaatccaccggagcaccaccaatagaagtaagcactcgatttacgactccatccggagcaaataaggatttgaaaatcatagaataagataccagtgaagtcgcacatggaaggaaaatcaacgtacggaaaattccttttcctttgatatgtggactatttaaaagctgtgccagtcccaatgctaagacaagcatgatcggaacttgaatgataaaataaaagattgtgttaaataaacattgctgaaatgttttatcctgaaggattctggcatagtttgaaatcccagtaaattccccgtttgtttttctaaaggaaagcaggattgcctgcgccatcggataaaaacaaaatacaaagattaaaagtgctgccggaatgagaaatgcccatcccgtaagattatgccgtttttctaaacctatttttttcatgtttttctcctaaaatagagccgggaacgcaagatgcactcccggcacgtcctatttcactctttaatgattactcattaatattaaattctacagtatcctgagcgtttttaatttcgctgtcgatgtcagcgccattctgaactacatttgtgattgcatctgttaatgcacttctgatgtcagagtagtatgcaccgtaatcgattcccggaacttttcctgcaaaatctacgatatctttatatactgtctgtccaccatagaaatcagaagcttcattgtaaacttcagattcagctgccggtaagtaacttgcgatcgctccggcatttggaagcaggtcgtcatataattctacgctttcgccaaatgttgatttaaggaaatcaaatgcaaggtctgtgtttttacagttagaagatactgcccagcttgccccaccacagtttgcgtaatttgtagcgccttcaataccatctaattttggcatatcaacgattgcccagtttccggactgctcttctgctgcctgaatagaagacatgatccaacatccctgaataacacctgctgcagtacctttgttcatagaagcgatgtactgatcccaatcagtgtaatctaccataactttttcatcgattaactgtttgtaagtttcgatagattttttcagtgcttcgtttccaactaagtccactttaccatctaccattggagaagcgcctgcagactgaagcatttcgattacaatttcagatccgcctgaacttgtaagcatcggaacgttgtttttctcaactacttttttcgctttttcgataaaatcagaccatgttgtatctttgaaatcatctactgtaagaccagctgcctcaaccatatctttacggattgccatgattgtagcaccgttgtcaaatggaacaccgtagttttttccatctactgtagagtctgctaatttaccagcagagaactgtgagaaatcaacacctgaatctgttaactctgtaaagattcccggatagtttgctacgtttttgtggaaggaataatcctgcattaagaaaatgtccggtaatgtgctgtaatcatctgcttctgctgctgtgattaaagcggtttcaatatcagagtatactttttcctgaatatccagtttgaaatccggatgatctttctgatacattttttctgcctgttccattgcatacacgttgaagttcggatcccaacaccatacagtaagtgtctcttcctgtgctgctgcggtatcatctttttttgcttcgctcttgtcttctgcttttccaccacatcctgcaagcacagatgctgccattgttgctactaaaaacattcccaatactttctttttcattgctatgatcctccttagattaaaaatattcttttataaaatatgaaacgctaccccgcattccataagttaaccttactcaacatcatcaacccagcgcatttcacccggttccatatctaatttgtatacacagttgccattgatgtaaacctctgtgtactgtgcttcggatgaattgttaattactgcaatcttcttgctcttctggaatacggttacttcagtatccacatttgttacataataacgtttcatctcattctccatacctgctgcataataaatcgcacgcagaagaattctacagttctgaggagaatatggaagacctgcaaaataaacactatgtccttttccatattcatttacaactaactggctgtattctccgtccattgcaaggacttgataatttttgccctgtgcgtaaactcggcttgttccctcaccaaagtctacttctccatcgatatcttctaagatgaaatgagttgcatccagttcattatacttatctgtattaagtgagaagcacatctcacggtctacaccaagtacatcagataactggaagaatcttccctgatgctggtaagcagtcggttcacccactccgatgaatccgcctccctggtcaacgaatcggcgaatacttgttacaaccgcttcatcaatccagttttcagctccactaaacgcagtatatgcgtctccaacattgataattactttgatgtcttccggaattccgtttttcacatcatcaaaagagataaattctacttcgaatggcattccacttaagcattccaatacgccttctgcggaataagtttctctatgccagattgcatgatgtacctgattagacatccatcttctctggctaccccaacaattgagaattgccaccttaaatggtgctacataagaaggagtttccttcatattttcatgaatttctctaaactctgtaacaaccttctgaatttcatcaataaatcctggccagttacttgcaagttttaaatatccgccgtatccgattcgatccaatggagaacgaagcagcgcacgtctggcttttctccagttatctcttgcttctccgattgggtctccgccttctccaaacacatccgggaagaagtatggtaacagacgaccttctgtataatctacacctttaatatcagaaatcatacgaagggttacaccacttccaacggaacctacgactgcatctaagccgattcctgcaaaatacttgccatacggttctgttccgatccaatgatctccaaggaacatcattgcttcttttccataagaatgtacaatgtcaactaattcttttgccagtgcacacacttcaatctgctggaattcgataaagtcgcggaactgtttactcggcacgcggaacatactgttgtgatatccctgatctacaatgtattccggacggaatttgtagcctgcccatttttcaaatttttctaagatatatgggcttacgcttgcgctatatccaaaccattccacatatttttctctttttttatcatcaaatgtcaatgtgaactgatggaaaaaagttgtaaatcgaacaacgtcaatatgtgggttttcctcacaccatcttttcagtttttcttttacatatttctgagtttttggttgtcttacatcataagtcaactgatgtggtgtatcctgccagtcatttgtaataaagttgtacatatgtaccggatcccaaatcaagaatgccagaaagctgacagtatattcatgatatggtattgtctggatttcaacttctcctgaaacttcatcaaattcccatttatctataggaacaatttctccagttgtgcgatcgattacttcccaccagcgtttcggatcatctaatgtatttacttttaactgttcggtatgaaaaccttccattaaacgaatacgaagtgtctcgcctcttgcggttacacgatcgctaatcaagtactcctgctgaatctcatccggattctgcattgcccactcattatcttttcttgtagtataataagtcgcatatttctttactggttctgacaaaagcgcttccggcatctctgttccgtcgcagtccctcaatgcatctgctcctaaaagattttttagccgtattgtttcgtcaacgatatctgcatcagtcggcagcgtaagtcttcccgtcatcaacactattccctccaaacaacttttttcttatcttttatctgatagctacagtatagcggacttcaaaaacgatatcaattttattgttgctcgttttgttatattttttgctattttatcaataaaatactatttttttatcaattttttatgtataatggatttatagagaatttcattttactattttttcgtcttttttacgaactttatttacctcacgtaacttaacatacaagactcgcacataataattaaaaggatgtttgcttatgagtaatgaatttattaatctcggttccgccaatagccgccctgaagattttaatcttcgttatatttcaatttccaaatatgagggtgactggcactccttgccacatacacatcaattttcagaacttttttatgttctgcgtggcgaaggaatcttttatatagaagataaaaaagtctctatgaaaacagatgatttaatgatcatcaatccctatgtagagcacacggaaaaaacacttccaaataatcccatggaatatattgtgtttggtgtcgaaggtcttgccttctcatttaatgacccagaccaagatggtactcaaggctatagcttctatagctatggttccgacaaaaatcagtttattaacttcgcacaactcatgatgcgggagtttcaggataaaaaatctggatttgaaaaggtctgtcatggattacttcaagtgcttttagtctatattgcgcgaaagcaaaacttgtctgtaatctcagactcttctttccggctttccaaggagtgcgcgcttgctaaacgttatattgatatcaactattcccagaatattacgttagattctttagcagaaattacacatatcaataaattttatctggcacactcatttacagaatgtatcggacaatctccgattaactatttaaccaaccgaagacttgaagcgagcaaagaactgttgacttcttcgaatttgtcggtaacgcaggttgcttccagtgtcggcttttcatctcaatcttatttctcacagaacttccagaagaaggttggcatgtcacccagacaatatcgtaaactgcactcaaagtaaaaaaatcctaacaagtgcaaggcaaattacgctttgcagcttcgttaggctatttttctgcatttaagaacgatttttttagcttttttagtatactttctctacttttctgttataatgatacctagtgtttgttaattttacttatatttggaggcttttacacatgaaaaagaaaaacgctgtacagacaatatcaattccctcagctcactccaataacacactgattcatcaaacttcaaacgtctccgcgaaaattacattatctgattctattttgtccggagccgttatcgaatatcgcaaagccggttacaactttattcgtcacttacatacgaatattgaaatttatcgaattctttccggcgaatgttatatggatattcagtccgaaacactccacttcacagaaggggactttgtcatgatccttcctgatgtggtacattccttttatctgaacaatacctcagactgtgagttccagcatattcattttgatccggatctattttcaacgattatccttgataatgatgggatttttccgatcacattgcttcatgcggtgttattctcttcccatttttattatcgactgcgttcggatgcgacgattgacgagcagattcaaaaattgattgatctgtatactgcttctgaaagtctgtttaccgcagcaaacgtaaatgttgcactgatgaatttgatgctttacattctcgatcataccgaaccggtgcatgaatacaaagaaccacagctacaaaatagctatgtcgcttatgcactgaattatattcacgatcattatactaccaaaatcttacaagaagacatcgcaatacagttgcaaatttcggtccgctatttaagcaagatttttaaaagctatatgggtgtgactctctcaaactatattaatatttatcgcattaactgttcaattgaactaatgcaaaataccaatttaactttgacagaaattgcgctgcaggttggatttaaagactcgcaacattattcaaaggtctttatgaatgtaattaatgagaccccttcacaatatcgaaaaactgtttcaaaataatatctaatacaaaacaggcaggagcgaatcatcttcactcctgcctactttattttcctttattgctttatcaagcggatattcgcaatccgctttcgctacttgctcataaccaaatagctactacgcagcttatcagaaggggcttgcccccctcctgatacaagcaagtccccacccctgcttattgctttttgcaattgaagcaggggacttccttgatttggttaaatttagtcttcttttttacgttttactacaacagttcctgctgccgctgcagacgctgcaaatgcaagtgcccatgctgttacgttcattgtatctcctgttttcggagaagtgatagagctgcttccttttccagcagagccggaacctgtagttccgctacctgtacttccgccacctgtgcttccgctacctgtacttccaccacctgctgctggttttttgttgtcatctttcttgttgtcgtcttttttattgtcgtcttttttattgtcgtcttttttattgtcatccttcttgtcatccgctgtttcttttactttcagatctttgaaggctttttcgattgctgcttttgcttcgtctacctgctcctgagttacattttcaccgttcagtacgttctgatactgttcgtaaacttcctgcagttttttcagggattcttctgtatatttttctttctcttctaatgctttctttgcatcttctgcagttttattcagtttttccatatctgccatggttataaatgtttcttctacttcttctgtgatctcagactcagtaccctcttcatttactgcagttacagcaacattatacttcgtacctactttaagaccagtcagctcatatcttgtttcttttaccggtgtcgcatttactttttcgccatccagatatacattatatccttctactgctgctcttgcgagaaccggatcccaagtaaccagtgctttcgtatgtttaatttcagagatttttacattagtaggagcggctggtttttccggagccggtttttcactttctaatgtagtaaatgtagttgcttccgatcttgcagattcatttcctgctgcatcgactgcgcttactcttactgtatattcggttgcttctgtaaggtctgtcagtgcaaattcagtacctgctacaagctcctcatttacttttgcttcatttacatatacgttgtatcctgctacacctacattgtcggttgcttcgttccatgtaagcttagctgttgtttcggttacttcggttgcttttacttctgctggtgcagttggtgcttcggtatctgtttcttcttctgcttctaatgtggtaaatgtaacagcttcggatcttgcagattcattttctgctgcgtccactgcggttactcttactgtgtattcggttgcctctgtaagtccggttaagtcatactctgtaacagttaccggagaagcatttacttttgcttcgtttacatatacattgtatcctactacgcctacattatcagtagatgcatcccatgtgacttttgcagttgtctgtgtaatgtcagctgctgctacagctgttggaacacttggtgcttcggtatcttttggttcctcttttttcagtgtagtaaatgtagcagcttcggatcttgcagactcattttctgctgcgtccactgctgttactctcactgcgtattcggttgcctctgtaagctcagttaaagcatattcggtacctgttacaagtgtatcatttacttttgtttcatttaagtatacgttatatccaactacgcctacattatcggttgcttcgctccatgtaacttttgcagttgtttcagttacttcggttgcttttacttctgttggtgcagttggtgcttcggtatctttttctgcttctgttgtaaataccactgcttcggattttgcagattcattttctgcggcatccactgctgttacagttacactgtactctgtagctgcggtaaggtctgttaaactgtattcagtacctgttacaagtgtgtcatttacttttgcttcatttacatatacgttgtatcctgctacccctacattgtcggttgcttcgctccatgtaagcttagcggttgtttcggttacatctgttgcttttacttctgccggaacacttggtgcttcggtatctgctactgctttgtctacatatgtaataatcggtgtgatatgcgcagatggtttgcttgggtttccgctattctttgctacgacacggatcatatcgccttgagctacttcaagctcttccgctttttcccagtctcccactttctctttactatttacaagcgttacactcttcttctctgtgccatttacaaagagacttaaggtaacagttccgtttgcatttccagactgacgaagatatggttcatcatcttttacgttgaatgtaacggttccgctcttcggtactcgatatgccattgcagttacaatgtcggagtttggcggtgtagaaagcagaccgtgtacggctggatttgttgtggtcactgtaccctgtggtgcatcaagacctggaccataataagtgtttactgcccagtttggccatccatcactatcatatgtggtcatatttgcccagtcgccgtcgcctctcttcatctgtccaaaccatacatttccctgctgtcttccaacataatctaatgtccagttgtatgtatttttctgtttcactgtatagtcatttttagttccgtcttctgcagtaatgcgaagtgtcattccctcttctactgcagcgccatcttccagctctgtttctccgtttaatacggaaacagttgcggtatctgctacagtgatattttctttcacttcttttacagtggtcggattgttttctgtgtaaggaacactcaggtttgtacctttcacttcataataacaatctttcagttctttatcagaacttgcaactactgtataagttacatcttccattccttcataagaaagcacgatagtagctccgccttttacgatatcggaatcgccaagtacgttttcaccatttttaatggtaactttaacgcctgcatctacgataacgttgttaaggaaatctgctacggttgtgtttttcggaagatcacttacgtttgttccggaaacagtatacacattggatctcagtacaagtgctgctactgcatcactttctgctgctccgatttccggtactgctgtgattgtatgtccgaagaaatcgtgatcgattgtataaccatttctatcaactactactttaccagcattgattgccggagagttttctgcaagtttgtatccatcaaatacggtctttgcatttggatcttcatgtgttcttgcttttttatttgctgctacagaatccggaccggaacctgcatcaaccagtacttttgtaccttcatttacttttacagcagctgcatcgtttggataagtacttacattgtagtataagttattgctgtaagttttatttccgttgatgttccagttacttactgtagccggtgtttttcctgcaaagtagaagatattattttcaatatctaccggaccaccattaccatgagtatagtgccagattgtattgattccttctttaatatagaatgtgttgttgtaaacctgacagtttccggagtttcctgccgggtctaaaggtcccatatcttcattctggctgatgttataacggaatgtattattgatagattccggaccacagaacataattgtacttgcagtatttccatggctgtagttgtactgatagtttgttccatcgccatagtcagcatcccatggctgtccatcgccatttccttttgatgcattcaatgttgtaaaacattcattatactggaaaatcgcatttttacatttccatggccagatacctgctgccacacgtcctgccccaacattctgttttccgatttcattaccatttgcatccagtcttggctgctgctgtgaataatcagtagtattaatctgctctgaaccattctcagatacattatactgaatcaacggtctgtcaagatacattgttgtgattgcatcaccacctacatgatttaagtagttgttctcaattaccacattagaggacgcatatttgtccatcactgcatcggataatgcacctgttgtgaactgtctccactgataagtgtatcctactgcgattccccaacgatttactgtatccagagaacagtttctaatctggacatcattgtatcttgcgattccggtttctccttcatttgttggctttgcaacgataaaatagataccaccgtttgtcatgtgtttgttataaacgttacctgttacgttgtgaatgtaaagatcatttaatacgatatgatctacggttccattgtcttttgcaactccggcaacaccggttcgatccattgcatatgcatcattatatgctttatctttttcggtatcggttgcactgtttctgtcatttgtcagctcaagtccttcgatttcaaggtattcagcatcttcaatcaaaatactggaagatacagtacctttccatttatgattctggttatccagcggagtaccatagtttaactcccataatccatgaccgtttgtattaatctgtggtctgtctccttctccgtaagtagatacttttaccggagcttctgctgtaccactatcttcttttgtaaatttaagcgcctgatcttcaaatacagagccttttttcagaagaatggtatcccccgggttaaggtcaagctcatttaccttatccaatgtctgaaatgcttcgctttctgaagttcctgcgttgctatcttttcctttttttgaatcaacataatacgttgttcctgatgcagcttctgctccctttgcactaacaggaactgccggcatcattgatgccactgttgttccggcaagtaccagcgccagagtactactcatccatttttttctcatgttgttactccttccatattattctatattcttcaaagtaaaccggctgacttgctccatatctccgtttacttgagaatcattttcaagctgtgcgatcttttcatcatacttttgttcacgcacttccctttcgactgcaattcttgcggtttcgagatccgcattttcctcgctgcctccaaaaatccagtctcgactttcataacattctaaaatctcggcttctgtcagctccatcccctcacgagtgagatcattgcagtattgttccttcaaggtactgacttcataatccaaatatagctggaatgtatattccttgagtccataaattacttcgccttttgcaactttttcgcttcgttctgcgttttcgtccttccaacgctgctccaaagcttcatagctgctgtcggatacatccccgcattcttttgcaagatcatacaccgcatgaatatatttcagctgctctacggtattttccgctaaaatttcataaccgtgtttgtcatcatactctttttcccagaaatcttcttcataaattgcattgtaatcttgttgaatctgcattttggtatcatactctacggatttcatacaatttagatattcctctttaccaatcgaatgttctccaaccgttaaatcgaattgcttgtgattattgtattggacggcacacgtggcaattcctgtgactgcaatcacgaatactgcaattccaaacttttgaaactgcgtttttcgattcttcatagtcttttcttcccttctgcatagggttttatcctgcctcctatacgcagactgtatctgtctaattttgacttcattataacaatctgtttctttttcggctcgtcctttttgattgattccatcgctgattttgtcaaattcggaactagaatgaaatttctttttttgtgttcgggcacaaaaaaaatgagcagaaaaccccaaccgactcgtcggataggattttctgctctatagtagataaaaaacaatatcctcgtcaatgacgaggatatcttctatacgggtatttaatactctgcttaaaataacaaagttatccagagttggcagggaatttcctgagagccatttataaatggcctgtggatattcaaatcccattgcttcttgaatatctttcacagtgtatcccttttctttaagaagtgtcttgatgcgtgtgccggtttctttttgcagaattgacaaatacacaggtttcataattttgcacctccatgaaattcaagtcgaaagccaggcttccgactgagatatgccatcccgaaacattatttcattttatcattttcagcaataaaaatccagcttttctttcttcctattctaaaaattttttaatattttcaaacataatttctatcttatccacctttttttctgtgtgataatgaccgcagtaccatttctgataattaagtctatcctcaattttatccaaccattcctctgttgttctatccaccttgctctggtctaatccttccaaaaagacttccgtcggttcatattttaacggtacggtatggcttaacactacatccacattccagctgagttcattcaatttccgttccacgttctgcttgatttcctcagaaggctgttcatccggccaccagccatacccatgaatcaatcggtacattctatcgacactatatgcaccgcctgttacaatagtctgctttccattaaaatcaaaaacctctccatcctttgcaaaaagcaaatccggatactccttttcataataaaccacaccgccacgccataatttttcctgatagcttcctatcgtctgcggtctttgctcatgatttccatgaatacaaaaaaatgtaattggtagggtttccagaaactctttctttacatggtcttttacccatccaaagaaattaatacctgcgtccccaagaataatcaaaacatcctcacggcttgttttgaatttgccgcaaaactgctcaatccgctcaaacttcccgtgggtatctcctgtgatgtaaatcacgattttccaccttcctttaaattgtaaagcgggggaatgcttatctgcgttcaactacctgccaatttatgaattacttttaccagtaattctgcatcaacaggcttcgcaacatgctcatccattcctgcttcttttgctcttattctgtcctccgtaaaggcatttgctgtcattgcaataatcggtattgtttttgcatcctctctgtccaaagaccggatcagtcttgctgcttcatatccattcttgaccggcatcataatatccataagaatgacattaaattcaccaactctgctttttctgaatcgttcaacagcttcctgcccattccatgctttggtcacgtcagcaccttcatttcgaagcacaaattcagaaatttccatattcagctcattatcttctgccagaagaatatgcagtccccgtatagaagcttctgattttttttcgatttcaactttgccgctcctgtctgtattaatccgaaatggaacccggatcacaaatgtagtccctacacccttttcactttcaaggttaattgttccgcccattttctcaaccagcttctttgaaatcgccattcccaagcctgttccggcaaattttgtacggcttcctgtatgttcctgtgcaaaaggctcaaaaacatatttctgaaattcctcagtcattccgattccggtatccctgcagacaaattccatcgtcggcatttctgtctgctctgatggaatttcccggcagctgagatagatatacccgtttgctctgttatatttcactgcattcgacaggatattcatcatcacccgtttcacatgccccggacttccgataagctctcggtgtatgatttcttttttctcccatacaattcggatattctgttctgcggcaatctgcttgatcacaataagcacttctttggaaatactacttagattgaatggaatttcttccataacgacttctcccgactccagcctactcatatccagaacatcatttaccagttccagcaacagattggatgcctctttaatttttgtcctgtattccgtctgtttctccatatcatctgcataatggtctgccatattaaccacaccgcagattccattgatcggagtccggatatcatggctcatccgctgaagaaactcagtttttgcctcattggcggcttctgccttttttgccgcgctcaatagttctgccttatatttttcatctttttcctgttcctgtttctgatgcgccagattggttcggtatgcccagaaccagaatatactaaatatcagaaaataaagaaaaataacgcttatcacacttaatggaaggttacggaacacttctatatccggaagatacgcatagatataataatccctctgcttcagcatgactccgtagcatccgcttccttctttcctcaaatgataaatgtgctgactgtctgtatgctttttcattgcctgaacaacttcgttgtcggctgtattctgtctcaacagactctcatcattactggcaacaacgattccctcgtctgcaacaagaatcgttccatctttctgagtactatagccatttaaaagaccctgtatcgtcagtgtatagtttctggcaaattccggagatgtgtaatagtagattgccacgatacccggtgcatcttttctggcacaggctgcaatatcgatatgtgacccatcttccctgtcaaaccgttccgaatagcttctttcttcatatccggcaaaatccatgataatgtctttttgcagatactccgtaatctcacctgtcagagactcatccatactgtattcacagtccgtctttccctctgtatccagtacaaggataccatccacccagagagtctgaagatttcctttgaggaactcccggcttagctgaccgccgttttctatttctatgttaatatttgtactcatctgtctggcactttcaatcgcacggagaagacttttggattccgaagattcattataatgagtgtaggtagagcactgcactttgacataatttacaatctccaccattcttttctctgcttccgttttttctgtgtggaagaaataaagcagggaaactacagccacacagattccaatcagaccgccgagcagctggattcgtttttcttttttctttctcttaatatccaagatcatccacctccagatacttttccggatcatccagatatttttcaatgattttcagggatgtgccatcctgacgcatttcttccagtgtctgatccatttgctcacagattcctctgtcatcctcttttgcaaaagcaacacctattccggtgatcatcagaggttcttccaggatacggaagcttgcatcataatccttcatatattgaacgatagattcctcgtgtgctgcaaccgcatctacatatcctttcccaagaaacgtatagatcagctccctatgtcccaggctgatcagatttcccagtttcgggattctttcatctgtccgcttcagaaagataccttccggtttggttgtggactggacagccagattctttccctccaggtcactcagtttatagatatcactgttctcatttacagcgaccacctgacggcttgctatatacggtcctgcccagcgataatcatcaagacgcccttccatggaaaagcagcccatgatacagtcaatttctccactctccaccagttcttttttcttctcccagttgatctggacaacatccacctgatagcccattcttttgaatgcttctgtagccagttctacatctatacccgtcggcacgccatcttcattcagatagttgtatggtggatagttatcgctgccgagggtaataacaggtttttctggttcttctttcgtgttatctgtgtttttacaccctgccagggtaactgctaaaaatcccgcaagcagaatgcctgcaagcactctttttcctttcatttttcgtctatccctaactatccctttcgtttttttcatatctgattctctgccatttgttactattctttgaaatatgggcattcataccaaaacagaagatatctaatctttttaggaataaatatcttttgcttttaagttaatgacattgcttattttcgctctaagcatgcgacagtttctacatgcacgctcgacggaaacatatcacacactgccactttttccaactgataattctcttcacacaaaatttttaaatctcttgcaagtgttgcagaatcacaactgacataaacaatgcgttttggtttcatctggagcatagtagaaagcagtgtctcatcacatccttttcttggtggatctaccacgataacatcggcatacactccgtccttttcgtatttttccggaagcacttcttctgcttttccgacataaaactcagcattttcaattttattgagtgctgcatttttctttgcatcttcaattgcagccggtacaatttccactccatatacctgttttgctttctgtgctaaaaacagggaaattgttccgattccacagtataaatcccaaaccgtttcatttccgtcaagccgggcatattcgagtgcagtctgatacaacttaaccgtctgtaccggattaacctgataaaatgaaagcggagaaatctgatatttgatgtctccaatataatccgtaatcgtttctcttccccataaaggaagaatctcatctcctaagattacatttgtctgttttttattaacattcaaggtaatacttgtcatacctgaaatttttgctaattgtctgcaaagtgcttcggcattcggaattgaagttccattgataatcagacagaccataatctctttcgttgtaaatccataacgaataagtacatgacggataagtccttttcctgtggtttcatcataaggttctactttattttcttccatataagaaatgatttcatttaaagtcatttcattaacttccactccaagcaggcagtttcggtttggaataatcgaatgagtccgtccggcataaaatccggttacaatatttccctctttgtcttttccaaatggaaactgtgctttatttcgatagcgccacgggtcttccatgccgattactttttcaatcgtaaagttatcaaaacctccgattctgcggaggtttgcttctactttatttttcttaaacgcaagctgggcttcataattcataaactgaagctgacagcctccacaggctcttgcctgcggacactttgcttctacgcggtcttttgacggctctaacactttcatcagtcttgcaaatccatagtgtttttttgttttcatgatttttgcttcgactttatctccaatcactgcatctttgataaataaagtgtaaccatctgcttttccgattccggcaccttcatgactcatatcttcaattgtcacctgtaccaaatcatttttcttaaattccattttatttattcctcaccgcactgtgtttttcttaagtttgattcaaagaaacggttgtatccaagccagtctttattgtctcccgctgaacggaagatttctgtaatcgtttccatcttggcatccgtattatctgcaaggtttaaagcagcagcctctgcaagtgccggttttttcggtgaaccatattcaagttcgccatgatgtgccagaatacaatgttttaattcactttctaattttgccggaaatcccggaatttcctttgccatatcgtgaatcatctctgtaccgatcataatatgtccgagtaattgtccgtcatcggtataatcattcatcggaaatgcacttaactccacggtttttccaatatcatgaagcattgctgcggtaatcagcaaatcacgatttaagaccggatatgctttgctgtaatactggcaaagacgcactaccccaagtgtatgctctaacaagccaccgataaatccgtgatgtacagtctttgctgctgaatttcccttaaatgtcttgataaattcttcatcttcctcaaagaatttcacaagcagtttatttaaataagcatttttaatgctgtgcacatatttcagtaattcttcatacattccgtcaatgcttttttcactgattggaagatagtttccaggttcgtattctccctcatgcgcctttcttgcacgtttaatgctgacctgaaggcttccctgaaaagaagtaacatctccgatgacatcaatataatcaagtgtgtcaaagtcatcaattccctgagaattcggttcccagatttttgcatcaattgtgcctgtcttatcctgtaaaattacattttcataaggttttccgtttttggtaactgccggctgtttatgcttacacagataaattcctgagattttttcaccttcacgcagttcattaataaatttcataattctcctaacctctggtcctttattggtcctctttctttttctttttttataatgctccgagtgtcacatcaaatgtaacctctacatatccttctgtcgcctgccgcattgcctttacttttattgtgtcaccgctgttacatgcttttagctgttgctggtattctttcatgctctctattttctcgccatttacttctgttatcacgtccgcattttgaattcctgcctgcattgccggagaatccacttccacactttctacaaaaactcctttgggaattccctttttctcggaaatctgtggtgtaattgtttctcctgtgacccccatatagacaatactctgattgttagataatgtttctattagttcttttatctgagaaatagcaagtcctgtcaccatgtttttagaatctcccaaagcaaaagactgcgcaataacgccaatcagttcgccttcggtatttaacaaaactccacttcccttttcacttccaacaatatcagtagtcagtataccatactctgcatcaattttggaaacagaatttgtcacagaagtcagaattccaaagccaatagaatctttatactccatcggacttccgactgcaattaccggttctccttgttctgcactgtaagaatttccaagtacagctgttccgattttacttcttgtatcagattcaatctctgaatctgatatctttaatatcgtaagcccggtacttgtatctgattttaaaaatcttgcatcaacaaccgtatcgtcacaaaactgtacctgaattcgatctacatttttcacaatcccatactgcgtcagcacataaagttcctgcccgttatccgctacaatcactcccgacatctggctttcataaggagtctgaaaccagtcttcatcacttttaacaccgataaccgttaccatcgcttcttttattttatctgcttttttcagtacttccttatacatttcgctataattatcaatagaaagtccggactgctcaccttcctccgattcgcttatgtcttctgtatcaatacccgcatctgtctgttgttcctcttttttctctgtctcttcgtcagttggaatttctactttctgttccgtcctctttttattttcaactgcctgcgaaatctgcggctctacaactgcaaaaaccagtgcggctgtaagtccaaaaatcgctcctgcccctgcaagaactcctgctgccttccacatttttttcctgtctaatggttttttcttaattgtttcttttataaattcatacgatccgtcttccttattctttttctcgtccatgtagattcctctgcttttttggtttttataaaaaactttttgagaacaccctgtctctcttggatgtcttattcctaatcatttggatgtcttattcctaatcattttactttggcatggcatcattttagcagacacttatgaacaatttatgaataactcttttcatttccccggatttagggtagaatgattaaaaacaattgacaaaataaaggtgatcaaaatatgaatgaaaaagcattaaaaactcttgaatattacaagattatcgatatgctcgaagcttttgccacttcttccattggcaagaataaatgccggcagcttcgccctctcgataatctgacagaaatagaaaccatgcagcaggaaaccgcagacgccctctcccgcatctatcagaaaggcagcctttcttttagcggagtgaaggatgttcgcggttctttaaagcgtcttgaagtcggaagtacccttggaatcggagagcttcttgctatccgttctttactggaaaatgcaagccgtgccaaagcttattccagacaagagacagaaaatgagcatacggattcacttgataacatgtttgagttaatcgaaccactttctcctcttgctaccgaaatcggccgctgcattctctctgaagatgaaatcagtgacgatgccagtaccggacttcgtcaggttcgtcgttccatgaaactgacaaatgataaaattcatacacagcttagttcctttgtaagtggaaattccagaacctatcttcaagatgccgttgtcactatgagaaatggacgctactgtattccggttaaggccgaatacaaaagtcaggttcccggtatgattcatgaccagtcttctaccggttctactatcttcgtagagccaatgacaattgtacgtttaaataacgaaatgcgtgaattagaaattcaggaacaaaaagaaatcgaaatgattctttctaatttaagccagcttgctgccgaaaatcttgacgctatttttgatgacgtcaaacttttatccgaacttgattttatttttgcacgtgcccagcttgcaaaatcccaaaatgcgaccgagcctcgctttaaccgagacagaatcattgacatcaaaaaagcccgtcatccattaattgataaacataaagtagttccgattgatatccgtatcggtgaaaccttcgacctgttaattgtaaccggtccaaacaccggcggtaaaaccgtatcattgaaaaccgtgggacttttaactctaatgggtcagtccggacttcacattccggcatttgataattccagactgagtgtttttcgtgaggtatatgcagacattggagacgaacagagtattgaacagagtcttagtaccttctcctctcacatgaccaacgtagttcgttttatggaaactgctgattccgattctttagtactcttcgacgaacttggtgccggaacagacccgacagagggtgcagcacttgcaattgccatcctttctatgcttcacgagcgtggcatccgtgcgatggcaaccactcattacagtgagttaaaagtctatgcgctttctactccgggtgtggaaaatgcttcctgcgaatttgatgtcgaaactctgcgcccgacttatcgtctgttaattggagttcccggaaagagtaacgcatttgctatctcacaaaagctcggacttccgctttctattattgagcgtgccaaagaacaaatcagtcaggaagatgaaacctttgaagatgttttaagcaatctcgaagaaagccgtaagaccatcgaatccgaacgagaagaacttctttcttataaggaagaaatcaaaaccttaaaagaacaattagaagcaaaacaggataaactagaccagcgaaaagaacgaattattgctgaagcaaatgaagaagcgcaccgtattttacgggaagccaaagattatgctgaccagaccatgcgtatctttaataaggccggcaaagacagcatgtctgcaaaagagctggaaaaacaccgttctgatttaaggaagaaaatggacaaggctggaaagaaagttgccttaaaaacaccacaaaaacaaaaatctacccttcgtccgcaggatttatcgcttggcgattctgtaaaagtcatgagcttaaatgtaaagggaacagtcagttccaaaccagattccaaaggtatgctgtttgtccagatgggtatcttacgttccaaagtccatatctctgacttacagttaatcgacgaaccggttatcacaggacctgcactttctcgtaccggagccggaaaaatcaaaatgaataaatccgcttctgtccgcaccgaaatcaatttgctcggaaagaccgtagacgaagcagtctcagaacttgataaatacttagatgatgcctatcttgcacatttaagcagtgtccgtatcgttcacggtaagggaaccggtgcccttagaaaaggcgtacacaattatctgaaacgtctaaaatatgttcaggatttccaccttgcggagtttggcgaaggtgacgccggtgttacaattgtggaatttaagaaataggggttaaataaatggtttcaaaacagaaaattttaatcgtcgatgacgacaataacattgcagaactgatttcattgtatcttaccaaagaatgttttaatacaatgattgtcaatgacggagaagaggcattaaatgcatttgcctcttttagtccgaatttgattttacttgatttgatgctccctggaattgatggttatcaggtatgccgagaaatccgtcaaaaatccaatgtaccgattatcatgctttctgcaaaaggtgaaatttttgataaagtacttgggctcgagcttggggcagatgactatatgattaagccgtttgattccaaagaacttgttgcaagagtaaaagctgtcctgcgccgttatcagccaacggtcgctcctgccggacagcctgccggaaaatacgtagaatatccagaccttgctatcaatctggcaaattattccgttgtctattttggaaggcagattgatatgcctccaaaggaactcgaacttttgtatttccttgcttcctctcccaatcaggtctttaccagagaacaactcttagaccatatctgggggtatgaatatatcggagatacccgtacagttgacgtgcatatcaaacgtttaagagaaaaaatcaaagaccatccatcctggtctatcagcactgtatggggaatcggttataaattcgaggttaaaaatacatgagaaaatctctctatataaaatttgtaatttcctacctgattcttgctttcattggattttttgcagtctccatgtttggttcctctatggtacacaatcatctggactctgtttacagcacttccttatatcaggaagccacaaatattgcccaaaaccaggcttctaaatattatagggaacaggcttccctggaaagtgtagcgcaaaatctggaaacattgtcaaaatatcagaatgtggaaatctggctgattagcaaaaaaggagaaattcttttaaatactgcatcggattcggatgataataaacttactgtcatcgaagattttaatcccggtcattcaaatggaacttactaccagaccggaactttctttaacatgttctctaccgaacatttaagcgtaatggttccagtcacttcccagttaaatatacaaggatatgttgccatccatctgccggaaagtgtgattttgaaccagcagaatcagattatgaatatcatttattctttaattttaattattcttctgattatgctctgtatcctgcttgttttctcttttatggtctatcaaccgcttcgcaagattattgccggtgcggatgcctttgcttccggaaacttaaaatacaacattccggttcatacaaatgacgaaatgggaacacttgctgtcaccttaaattatatgtcagacgaacttgataaagtcaacgaatatcagagaaaatttgtcgccaatgtctcacatgattttcgttctccgctgacttcgattaaaggctataccgaagcgattttagacggcacaattccggtggaaattcaggataaatacttaaacatcgtagtctatgagacagaccggctttataaactgaccgaaagccttttaaccttaaatgacattgatgaaaaaggacgtatgcttgacttttgcgattttgatatcaatgcagttgtcaaaagtactgctgccacttttgaaggaacgtgtcgaaaaaaacgaatttctattgaactggtcttaaccggacagaccctttacgtgaatgccgatatgggtaaaatccagcaggtactttataatttgattgacaatgcaatcaaattcagctctgctgaatctacgattaaaatcgagacttctttaaaacatgagacgatattcgtttccgtaaaagacagtggatgtggaatcccaaaagacagcttaaataaaatctgggatcgtttttataagattgattcttcccgtggaaaagaccgaaaaggtacaggacttggactttcgattgtaaaagaaatcattcgctctcacaatcagcatattaatgtaatcagtacggagggcgtcggcacagagtttatcttcacactcgcccgaacagaagagggaaacagaccggcttaatataccggcactgtttccctcttttttatttccaatcgtattttgtcaggtgtccttctaagcgcatatggtcaaaattgttctgacgcagtgcttcatagagtacaattgccacagaattacttagatttaaagaacggatatctccaatcattggaatacgaattgctgtttcctggttttccagcaaaatttcttccggaattccaccgctttcttttccaaacataatatagcagtcctcttcataatgcacatcaacataagtctgaggtccttttgtagttgccatataaattttcgcacctggatttttctttaagaaatcttcgtaattaatataagttgtaacatccaaatctttccagtagtccattccggcacgtttaattgctttttcatttaatttaaatccaagtggttcaatcaaatgaagtctcgttcctgttgccacacaggttcttccgatattccctgtatttgccggaatttccggctcaaacaggacaatatttaattttgccatttttcttttctcctttaagactaataaatcttctattcgtatattactgataaattttatataattcatcactctgaggcttatccatgtatctggtctcttccccatttcttaaaattcgttcgtttttatcagtcgcttttccgattacagaagcttcaatacctgcctgatttaattttcttaccagaccatatccatcatctgttgcaatcatcatagaaccgctggacattaagatataaggatttaagccaagcaattcgcacacttcaaccgtttcctgacgaatcggaatcttctttaaatcaatatcaagaccaacattcgaaccacttcccatttcccagagtgcgccaaagacaccaccttctgtaatatcatgcatggcagatacgccccattcttttgcgatttttgcttccggcacaacagaaagatactggtcaaagtgttttgctgtctccacaaaagatggcgcaaagcgttctaacaactctgcttctttttcttttgcggcaatggatgttccctcaaggccaatccatttggtaatcacgatatcctgtcccggtttcacggacgaagttaccaacacttcttcctttttaattgttccaacaccggtcacagagattaacggatgttttactacatcagtaatctcggtatgtccacccattacttccatatttaactgactgcaggcagattccactccacgcatcatctcttttaattcttcttccctggtttccggtgtcagaagcatggtaagcataattccaatcggttctgcaccggaagccgccaaatcatttgcagtgatgtgtacgctgtggcttccgatatcttttactgttccggtaatcggatctgtggaaaaaactaaaacgtctccctcttttggctcaaaaactgcacagtcctgtccaactgccggtccgactaatatttcttctcttctgtgttttacttcttttaaaacggaacgaatcaacataggttccggtaattttcctattttcatcacagttactcccgtattctcttctctatttttttcttataccagataaaccagtgctgccggaataatcatcgccagcgccagaataactgccagtacacctgctacaaccctttttttcttacctgtcattttcatcataatttcattcactccattattcttccataagacgacaaaattttgtcaattaaccttgatgcttcactttttgtaagcgcatctgtttctacattagaatctattctatgatattttatcaaatcctgcaagtatcgtttttgtcttggagttgccggactttgttttttcgctttatagacaagttgatacggtttaaacacatctggatttgacgcttcatattcctgtatgaatctctgataaagtttatgtgtcaccagggcatcttcaaaggcacgatgcgcatgttcctgctcaatctgatagtgcatacgcagagcctgaagccccttttcaggcagttccggcactaaaactcttgcaatcttaagcgtgtcaattccctgatgttcaaactcaagtcctgaatttaccgcccattgttttacaaaactgaaatcaaagataatattatgaccaagcagaggaaatccctcgcaaaattcaaccaattctccaacaacctcaccaattaccggcattccctttaccatcttctgagaaatcccggtcagtgccgtaatccgctccggaatcttcatctgtgggtcaattaatgtggcaattcttccggtttctcttccttcttctatcttgactgcaccgatttctaaaatccggtcgttttttggtgacagaccggttgtctccaaatcgagtgccacatagttttccattttttatctcctctatctttgaattttctacattttgggttactccagctctttcttttacttcttacaattcatctcttatacttataattgaacaaaaaccgcttttgcatcattcgtcagcggacttctctttttataatcgaataagaccggataagcacctttttcttcgttttcatttatgacatcataagtaaacacttcaatgtgcgtcatttttatcgtctgtcttgcctgatagctctgataatcggttaacagttttggattttcctcttcttttttataaaaatccagaatctgcatcttataagctgacaaatcatttgcccactgcggtcttgttttcatattttctcttgcgtataagtcaaaaatcataagctgtttaaaatattccagatttgcttctttttcctgtaaaaattcctgtaaaatttcataacgacggattctggtatgagaaacctcgttataaccgtttttctcataaaaatctgccagttcttcatacatcgaaaaggccgtttcaaataagtattccatagcacggatggttttctggaactgaccgctattatagtaaacttccaccatttcctcaacgccttttagctttaaaatctcttcataagagagccagcgtgttccaagcacttcataaggtggttttgccttatgcacgcagccatatccttccgctgcctctgccatataagaaccttttaagacttttaaaaatccaagctgaagctgttccggttttaacgcatagacatcattaaaggaatgtccaaaactctcataattttcataaggaagtcctgcaatcaagtccagatgctgatgtacattctctcctttttgtaccgcttttacttttcttgtgatttcttcaaaatcagtctttcgatggatttctgcaagggtcttttcattcgtggactgcacaccgatttcaagctgaatcaatcctggccgcatcgtctgaatcagagcaatttcatcctcggttaataaatctgctgctacctcaaaatgaaaattcgtaattccgttatcatgctctttgatataagtccagattgccatcgcatgacttttcttacagttaaaggtacggtccacgaattttacctgcggtactttgtgcgcaaggaaaaattccagttctttttccaccagagaaaaactgcggaatcttaactttttgtcaattgaagagagacagtaactgcaggaaaacggacagccccgactgctctcataataaataattttatgttcaaaatcttttaaatcttcataaggaaaaactaaatcatccatattcatgatatctctaagcggtgtctgatggatcgttttgttttcctgatacacgattccattgattccatctaaggattctccctgactttttccgatttcataatagtttattaattctgtcagtgttttctctccctcggcgcacataattccatccacttccggatgtcgttttaaaaatttgggtgcgtcataagacacttccggtccgcccgcccaaatcgtaacctccggcaggatttttttgatgtcctctataatctcttctgcataagaaagattccagatatagcaggaaaaacaaagcaagtccggctttgcctcatagattccttttaaaatctggtctttttgctggttaattgtaaattccaataactccggttcatatccaaaggttcttgcataagaacgcagactgtaaaccgccagattggaatgaatatattttgcattaattgcaactaatactgttttcataagtttctgttcctctttttatttttcaatcgatacaatgttgattatacacatcctattttattttttaaagaccaaaaaagaaaaagacagctttcactgcctttttctcatacaataaaaaatatttattttttctttaattttttaacaaatcgagtttcatctgccggagaatgatctgccataacttttgtatactcattttccacgtaatctgctttttcatttccttttgaagcaaaagtcatctttaagaagattggtgaaatgatggttgtaataacaaccacgataacaaccggtccaagtaaggaagatggcatcagaccaactgcatttccttttgaggcaacaattaaagcaacctcacctcgggaaatcatacctgcaccgattcttaagcagtcctgtgtggaataatgacataattttgcccccagtccacatccgattacctttgtcagtactgcaacaaccaccaatgctactgcaaagatgataatcattgcgctcatatccggaagttcgacctgaataccgatacttgcaaaaaataccggagataacaatatataagaaagaatattaaatcttcttgcaatatagtttgtatgagtcgtgtttgtaataatcagtcctgcgaaaaatgcacctgtgatatctgcaactccgaagaactgctctgcacagtaagaaaacaaaagacaaattacaaatgatacaataacaaaacgctgtaaatctcttttgtatccctgcacccatttctggaaaactgcgtggatgatatatcctccaaccccaacaaatacaaagaaacctatgatttttacaaataccattgccacattgacactcgggtctgcaaggcttgtaattactgtcaaagcaataataccaagaatatcatcgataactgctgctccaaggattgcatttcctgcttttgtgttcaattttcccatctcttttaaagtttcaacggaaatactaacactggttgctgttaaaataacaccaatgaaaaagttctggagtgttgtacttgcagtcgctgtggattcaatcatacctgggcggttaaaaatccatgcaattccatatccgccaacaagaggtattaatacacccataagtgcaatgataaaggatgcctttcctgttctttttaactcaccgatatcggtttcaagtccggcacaaaacatcagcacgataacaccgatttcagaaacctgatgaataaattctgtctcttttaagataccaaggcaggctggacccaaaatcagtccggcaagcagtgcaccaactacttgcggcatctttacccttctggtgagaagcccgagcaattttgtgctgattagaatcaatgccaagtcaagtaaatacgtgtaagaatccatgttttccatctcctctgttatttttttgtattttaaaaaaacaaaaatcgagttaatggtaacacactttatctgaaaacgtaatatacaatatcaccaaaaaaatcgcggcttttacagcagtttttccattctaattgagaatgccgctacattgatttacgttctgcaatctccgccattttggcagcatttaaacgggtatctccatggacacggctataggaaagataaccgttcatacggtcaatcttggtcagattcttagagccgcataccgggcaaacatccatttcaagttcctcatgtccacaatcatcacagtatgccagggaaagattgactccttcgtaatatcccaaatccattgctcttctgactaaagagcgaattgcctcaacattgtatccaatcggataacgtacatactggatttttccaccattacacagttcccagaaacgaccttcgcagtcctgtttttcaattggagtgatatcttctgttacatggcagtggaagctgttactgacataaggtctgtcagaaactccttctacaattccatacattttgcggaactgctctacctgtaatccacacagactttctgccggtgttccgtaaattgcatagagataaccgtcttcttctttgaattgatttaccttatcattgatatactgcagtacttcaagtgcaaattttccatcttcacgaatggattttccattgtataattcctgaagctcatttaatgcagtaattccaaaggatgctgtcattggctttaataatggtttgattttatcggatggttttaaatgtccgccataaaatcctccctcacagtaagccaacggatttgtagacgctttcatttcacccagataatcgtaagtacgaatgtgaagctgtcgaatcatttccagataaaaatcaagcacctcatagaaatcacggttctctgcacgtgcttttgccagaatcatcggaagatgaagactgactgcaccaatgttaaatcgtcctacaaataccggagcatccttctcgtctgccggtttcattccgcctcgttcataccatggacttaaaaatgcacggcatcccatcgggctaatgacttttttataacgtttatacatacttgaaatgtaaccttttccggtaagggaaagccagtccggatacatcgtctttgcagaacaggaaattcctgcctcaaatacatcttctccctcttttcccggtccatgaagctcttcatcgtataagaacacaattttcgggaataaaaccggtttcttatggtctttctttccctgtccgtctttatgtacttcaagcagggaaatacttgccattttttcaaaacgccccattccaagtccaagagtcaccgttacaaatggatagtcgcctcttgatgagccgactgtgtttagtttatattcaattccctgccagccctgatcaaaatcacgacgcaccttatcggctgcatactgttttgcacgttcttctgcaagctcccagtccgggtctacatattttaaaaattcttctttgtacttatgataactcttttctgcataaggagctaagattttgtccacttccggaacagtaaatccaccgtattgctgggctgcggtacttaaaataatatctcccattacatcaaatgctgtatcgagtgtcttcggctcattgtaccacacatttcccatctcaaaaccgccacgcagtacatttgccacatcaaaaaggcagcagttcatggtatccagacgagcggactggtcatgaatataaatataaccatctttacatgcctgcagttcattgcggttcatgaaaaatttacgatacagctctttattcaactcattaaaaatcagacttctcttggttgcaaccagcgcactgtctgtatttgcattgctcttatctccaatataacgaatggactggctcttggtataaacttcatccatcatatgaataaaatcatgtttgtaatttcggtaatcacggtaacttttggcaaccgccggattcactttttcaagtgctccttctactacattatgcatatcctgtatggaaatttccggttttcccatgccttctactttttctgttgcataccggcagataaaatcaatctcctcttctgtaaactgataaagaatccttcctgccgatttatttaccgctcttacaatcttctgcacgttaaattcttcttttgtcccgtctttttttataatacacaccatttcttccacctctatcgccacactatatctggtatgacattttatttctttcgttatttttatcccatatttggtattagccagtatagcacattttaccggtcatgaaaagagggaaacttgcacaaatcttgacgatttatatcaagtatccccttaaacatcttgttttacacgatattgaccaatttgataaaaatttttctttttatttttttctcagcttttctcttacgcttcaatgactccgtcaaatacaacagttgccggacctgtcatataaacaagattttcttttctgtcccagaaaattttcaaatcaccaccaagcagttttacggttacttcgtcgttcgtataaccatttaatacacacgcaacagcaaccgcacacgctccggttccgcatgccagtgtttctccgcttccacgttcccatacacgcatctctaccgtattttcatcaatgacatgtacaaactcggtatttacgccttccggaaatgccggatgcttttcaaagtacggtccgattttttcaatctccagtttctcaatttcgtccatatagaccaccgcatgtggattacccatagatactgcggttacttcataaacatcgtcatttacgccaagaggctgactgataaccttttcttttttataaatcatcggaatctttgcagcttctaattccggctgacccatatttacttttaccagacttacttttccattttctacggtcagttccaaatacttaattccgctcttggtatctacgctgatgctggttttatcagtcaaaccgtaatcatacacatactttgccacgcagcggattccatttccgcacattgcaccctgacttccatctgcattgtacatttccatctcaaagtctgctttttcggatggtttaatcaaaatcagaccgtctgaaccaattccaaaatggcggtcactcacttttattgacagctcagaaggattttctacgttctcttccagacagtttacatatacataatcatttccaattccatgcatcttcgtaaatctcataattttcaagcctctctttctaatgattacatcaatcatagcaagccttgatttttttgtcaatgtggcagaattgccgaaaaaaaattttgaaaaaaatactttatttaatgaaaaaaagctccaccttggaaacccaaggcagagccctttcaaattggaaaagtatgaggagttacttttccagatggcaatctttttttatgcagacatcttatacgaactgtgctgctacgattgctgcaatcattaacggaatgttaaagtgcaggaatgtaggtacgcaagtatcccagatgtggtcatgctgaccatctgcattcagacctgatgtaggtccgagtgttgtatcagaagccggtgaaccagcatcaccaagagctgctgctgcagacatcaggatgatagttgctgccggtgagaatcccatcttatgacacagcggaacgtaaagtactgcaagtacaggaactgtaccgaaagaagtaccgattcccattgttactaaaagaccgattaatgtgatgatagttgctgcaacccatgtatttccattcataaggctgattgcactgtcaaccagttcttctacagcacctgtgctgtttaagactttcgcaaatccacctgctataagcattacgaatgcgatgaagcccattaatttgataccgccgttaaactgttcatcaatatctttaatttttacagctccgaatatgaacataactaaaagtccaccgaatgctgctacaggaagagaaccaaatttaacctgaagaattacgattacgagtgctgctaaaagtgtaatccaatgtttgtattctaatttcaggctttctaattcatgctgtccctctaatttgatatcctgatattcacgaggttttctgtatgtaatgaatacggcaattgcaagaccgataatcatagcaactgcaagaatccagtttactcttgtaacatcaccaattgttattttccatccaaagtctactgcattctggttgatgttgtctcggatgattgtcataaaaatcagaccaaatccgaatggaagagcgatatacggtgctttgtgaccaaatgcgatggtacatgcaacaccacgtctgtccagtttcatcttgttcatcatactcagtaatggtggaacaagaatcgggatgtatgcaatgtgaatcggaatgatattctgagatgcacatgcaatgattaataagattcccagtaaaagccatctgttaccctttacagtttttgcaattttaacagataagatttctgtaatgccggtgtatgccatacaagaagcaaatgtaccaagcaatacgtatgctaaggctgtttctgcgttagaactgaatccgtcgataacgcagctcataatactcacttcatctccggagctgacaaccggcaaacccccgataagaccggctacagtcagagatacgagcatggagagtaatacattaattttcagcagacacaatacacaaagtaagagtactgctacgattacaggatttagcatagaattacctccctcttttcgtaatatttagtttttttattttgtctctaatgaaccactgattgcctcctcaactgctttaatcagtgcatcattcttaataatttcttcacagtaattaatatcaccgtataattctctatcctggtctaaggtagcaacttctttacgaactaagtcatacgctgcctgtgtacctttaccaagacctttgttaccacgcatatcgataccctggcaggctaccataagttccatagcgagtacacgtcttacatgttctgcaattgttccagcttttcttgctgcaatcatacccatagatacgtggtcttcctgacctgctgaagatggaatactatctacagatgccggatgagccagaactttgttttcagatactaatgctgctgctgagtactgaacaatcataaatcctgagcaaactccaccgtgtggtgttaagaatgccggcagatcgctgtacgctgggttaaccagacgttcaatacgtctttcagaaatatttgctaattcagatgtagcgattcctaagaagtcaaagctcaatgccattggctgtccgtggaagttaccgccggagataccagctctgtcttctttaaagataattgggttatctgttacagagttaatttcgatatttacatggtcgagtacgtagttgattgcatctttacttgcaccatgaacctgtggtgaacaacgaagagaataagcatcctgaacacggatttcaccctgacgtgttgtatttttgcttccttcgagtaattttaacaggtttcttgcagtagcaagctgtcctgaatgaggacgtacatcatgtactctgtggtcaagtgcatctacaacaccattctgtgcttcaaagcagagagcatctgcgatatctgcaactttgactaattttaatacatcatataaagcaagagcaccggctgctgttaaagcctgagtaccattatttaatgcaagaccttcttttgcagataattcgattgtaggaatacctgcacgtttcatagcttctgctcccggaagcagttcgccttcatagtaagccataccaagaccaatcataggaagaaccatatgtgataatggtgccaagtctccagatgctccaagagaacccttctgtggaataaatgcggtaacacctttatttaacatgtttaccattgtttcaacagtttctaaacgaataccggagaatccttttactaagttgttgatacgaagtaacataacaccccttgccacatcaattgggaatgggtcaccggcaccaactgcatgagtaataattaagtttctctgaagttctttacactgttcctgagaaattacaacgtcactgaatttaccaaaaccagttgtgataccgtaaacaactttctcctccgctactaagtcgtctaccacttttctggaatcaatgatattctgttttgcttcttctgctaattcgatttttgcattttcgcggcagattaaagcaagctgctccaatgttaaatcatttcctgtaattacgatactgctcataatcgcaccctcttttcgtttattttatagtgcaattatatctaatagtacgtcaaaaaaacgtcgataaatgtaagaaacgcacaatctattttttcgaattgttttattttttagcacaattccccaattagcggacatcattctttatgatgcggacatttgtatcagtacgttatcatggtaaaactgtaagttgaattttttctcaaaaactttgttttttcttttgtgtaaagcggacattcgcaatccgctttgctacttgctcatgaacgcagtcgctttgcgctctgcacacttgaagcggaggaatgcttatctgcgttcaaaaaaagaagctggctctttttagaacccagcttccttactgatctgtctgataaccgaaacggttgtcggattattcattttttctgtcaagcttactgctttcttataatgtttctttgcctggtctttttcaccaaaccgaagcagaaccagtgccatatatgcctcagcacgctccagtccccaatagtatccatttttctcaaaacaggcaatcgctttttcaagatacgttctggcctctgtatttttttccataaaataatatatctgacctacattagaataaaactgtcccagaccatttgttacgactttttctgttcccttttctatcgctattttataataagaaagtgcagattgatactctttcatttccctgcatacatctccgatgtaattatagcaagccgcaatattcattgcatactgtccgcttcccccgtcgcggttttcaaaaaactccctggcctgtgtcagaagtgccctggcttcttcatatcttccctcatgaagcagataccaacctttgagtctcataaaaatacctttttcatcggtatctgtctcatcgattaatttcattccctctttcacatactttttaaccaacaaaagattctctatctgaattccatagaaaatcatctgtttataattattcagacgtgctttattatcatttaaggtctctgcaattgcttcacttgccttgatattcgccagtccggtttcatattctccgatagcaatatcaaaacgaccttttacataatacatttccattttcatttcctgaagctgatgagaatctccttcaaaccggattacctcttctgccaggcgcaaaatttcatctgcctgaaaagaaagttcctggttatcgtcgccatattccatctcccaatgaagaacaggaaagttttcattgactatcgtataatattctttcaaatatgcaattttatattgatataccttcaccagattatggcacttctcatagtggtgaattgtcattgggagatacgcaaaattttttttccctgttgcttttgcctcgtaatattctgctaaaatctgatggtatgctctctttttacctacactttgtttgtcataaatatactctttaaacacctgatgttcaaatttataataaacattccagcctactaagagttctttgattaaatgtcgttcctgaagtttctctaggacacgaaccaatgtcaggcgatccatatccagatgcaaaagctcaatctcttcgatactgactttctccggaaacagactcatacagtttaatacctccaattcctgttccggcagcccaaccagacgcgcttttatcacattgttggttttctgtgatttttcaagggtataccctttttctttcatcagattaatggattccatcaggaaaaatgcatttccttctgtcatgcggtatacattctgtcgtttcttttgatcttcactcaactccggaagaaacttgcataaaatttcgttggtttctttttcattaaacggaaacagattaatcacatgaagccagcctttttttacaatgttatttaaagactccatcacatcggcatctttttcctgattaaacgtgcacatcaaaagaatcttatgcgtaccaaaagtaagaagcagacgatttaacagctgaatactggtctgatccatccactggatatcatcaaaaaacagaaccactttattgtgctccaaaatcttacggaacatgtcaatcactgcctgctccatgacctgataattcagtgcaccggattttccattttcctccatgacttttcccttaaaaaaatgttccagctgttcccatttttcttcactcatggattctcttaaaacctgataatccgccctctgttccacttcccagaaaatatcactccatggacgaaggaaaaattcggattcctcacgatagcaggccgcatacagaccaatcatctgatagccctttaccatctgcattgctttatcaagcagtgctgattttccaacaccgtcttctccgccaattgccacacatctgggacatccatcttttgctccgcccacaatacattcactgatttggtaaatttcttcatttcttccccagaatggcaggttccagataacaccatctgagtttgtatttcctttcacattaaaaatccggtgaaataattcggttacttctgacgatggttctacgccaagctcatccgcaagaattttctccaaatcataatacaatttgattgccatattatagtttccatttaaggcataaatatccataatttcataatacagcttttcattatacggatcctgttttaataaaatattactatatttttgaatttcttccatattttttgtcgcatccgctttatacagtttttcacgtgccactttcacgaaccgtttattatactgttcctgcatggctgaaatccattcctcaaattcataactgtttttaatcatgaaatgagaaagaaatccctgctcctctgcatcaagcaaattctcatcattgagattatcccagtcaatttctggcatacactccggattaagagaaatgcttgtatgaccaactgtcacaaggatttcttttcctaagagtttttttatctgatatactgcttctctaaggttttttcttccaacattttcgttgtccgctccccaaagcacagatatgatttcctctctcgttgctgttttctttacacacaaatagtaaaaaaagccctccgccttcttatatggaaagttcactctctccccatccatctccacataagggcgtcctagaagatatactttaatatttgccactttttatccctcacatttgtaatagaagaacagatgaatattgccatttttcattctgtccggtatctttgatccaggtacaaaaccatacccacttttcagttctatattttagtatactctactcgtacaacttgtgtcaactcttgtcaaattgtctaaaaatttattgaaaatattttctttctagtataagataaacttatcatcaatcttcagagggggaatcttattgttacgaaaaccaaaaatactctattactcaaatggacaaactcaaaaagaaaaagccatcgaaaaagccgcaaaacgccttggcgcagattttatttccatttctgaaacagattgtacccagaccgtcggttatcttgctaaagtaaaaggatttccagtgcataaaacttctattctggaaaacatctctgctgtctgtcaggatgtgatgattctctgctattttccaaatacccgtctcgaccttttacttgcatctattcgaaacggtgaaactcctgctgttgatttaaaagcaatcctgacaccacaaaactgcttctggactttttctcagctttatcaggaattacttgaagaacatttaagtctgttttccaatcaggaatgacccattctatcttatcatagcacaactacattaataatatagaagaaaaagtcggttttcgagatagaaaaccggctttttcttcttagaacatctttttaccaaatggattttttatttcgacaagcttttttactactcctgctgaaatagtgtattgaaaacctgaatatgtcgtttgacattttcataagttccctctgtcattgctgtatttaagtcaaaatagttatgcttttcatttgaagcaatatattcttctactttctttgttaaactgttaaaacttgctgtcgcaatatttacttttctgattccaagtgaaattgctttctggaaatctttgtctgtaattccgctccctccatgcagtaccaacggaatatctacattttcatgaatcttttcaagcacatcaaattccagtgttggagctaccggataatttccatgcgcattcccaattgcaactgctaatgcgtcaattcctgtctctttggcaaatacctttgcatcatccgggtctgtacaacggattccatggtcacagcttccatcttcacttccaccaaccagaccaagctccgcttctacagttgctccatattgttttgccagctctactactttttttgtatttgcaatattttcttcaaatggaagagtggatgcatctaacataacagaagtaaatccaagttccagcgctttctgtaccgtttcaaatgtaagaccatgatccagatgaactgcaacatctactttcgcttcttttgcagcctgaaccatcattggtcccattagatgaagtggagaatgtttcagtcgcacctctgcaatctgaagaataatcggcgtatctaattcctccgctgcctgaattgcacctcgtaccatttccatatttccaacgctgaatgctccgcatccaatattatttttctgtgctctttcgagtaattctttcatttttacaagtgacataatcattctccttcctgacaaactgctgtctgacatgcatttactttttcttttttaatttctctctctaataaaattaaagaaatcaatgcgagtgctgcgctgaatgctccactagcaaatacagcgttgatgtcatatccatttccaagcacggtattggtaattgccggtgcacttagagttgccaccgcaataccaaacataacatatccataattttctccagaatgttccattccaaaaatagaactcgataaagatgggaaacttcccataattccaccataacaggcatacatcatcacaacgcatacagttgtaattcctgccggtgcaaataccaagagtaacattgcactcactgctaccaccaatactacttttacacagataactcttcctactttatccgccgctgtcggcagacaaagccttgtagctgcattacagaccgaacctgccataaccgccgcaactgcaactgaagcactgattcccctgtccatctgtaccgtctgtgacaatggagataaaatcagatatggaatcaaaccaaacatcatagttgcaagcaggaagtaaaatttctttgtgcggaacatttctccggatgtatactgttttcctgtgtacaccggctttccgcctgcctgtacactgcctgttccaacttcccctgtttttggatttcggataaagatacttgccaaaatccatgagattccaataaacgttccgattattaaaaatgttttttcaattccaactccagaaagcaaacttctcgaaaccggtgccatgaaaaatccaaacagaccgtttgccgttacaatcacacccgatgaaaatccggttcttcccggaaaccatttctgtgcggtagaaagaatggttgtataaatcattccctgtccaaatccctgtaacaatccatacgtgatatacatcatgaccggtgatggtctcagtgccagtgcacttaacaaaatactggctgtaaaaattgcaccgcccgatacgattgcaatctttggatttctcttatcctgaattcttcctcctacaatatttccgagtacaaatgtgacaaaactcagataaaaacacatcgatgtctgaccctggctccatccggttaactccattgcatacggctggtaaatcgaccagatatgtggataacctgtaaaaaaaatggcaaatgcaccaaataccagtatcagatattttgtaaccgctcctgtcctttcttttttcatagcttctccctcttctttttgataatattttgaatatcttttggttaattcttgattataaattatcatctttttggtaattcgtcaatagtcttttcaaaatttttaaattttgcttcacaagttactcaaaatattatacaataatactcacaaaacaactttttgaaagagggtttaatatgagaaccaaacgaattgacttaattgaacgttatatagaagaagaaaaactggtttccttagatgtactctgtgaaaaattcgctgtatccaaaaacaccatacgccgcgacattgaagaactggtcaaaaaaggcgtcgtagaaaaagtatacggaggtgtttcctttaaagtaccaccatccgataccccactcgttccttatgaaaaacgccacactgtcttaaatacagaaaaagataccatctcaaaaaaagccgcctcttttgtaaaagaaggcgacattatttacattgataccggaacaacctgcttaaatatggtcgattatctggcacatgttccatgtacaattattacaaacagcctgaggatttttatgaaagctgtacaatatccggatttgcagattatttctcttcccggcagactaaaccgtgatacattatcctttgtcggaagtgaaattccaacctatctgcgtacttacaacattacgaaagcatttatggcatctaccggagtcactattcaaaacggtctgaccaatgcctctgccgatgaatatgcaataaaaaaaacggtcgtagaaaacagccagacccgctttttactctccgaccatacaaaattcgggaaatttgcactcatgacttattgtccacttagtgaaattcaatatttgattacggatactacgccacaacagaaatatctggattactgtaaagaacatgaaattataatagaagtgacaaaataagtttcgtacagtgtaaattaagcagctgctatattgacaccgaacgattttctcctatacaggcagagaagtgagacgtagcggtgactacgacgattgacgaaaacgcattaaataaaaaacggctctcaatcacttgaaagccgttttctcagttcttatacaaactgattacatcctttatcataagtataatcaatattgcccaatttcttctctaattcgcttttgtccaaattcattgcctggcacatatcatctaaagaagaatagaaatctctcagtttcaaatttacaaaacttaacaaaatcattgggtctttcggtatcattttactttactccttcttcacgctttgcggtcaattctccattttctacgtctatgacgatggtatcttccgctcttacacttccggaaagaatcaattttgcggtcagtgtttccacatatttctgcagatatctcttcagaggacgagcgccgtataccgggtcatatccgccctcaataatatagtcttttgctgtatctgtcaagcgtaaagataattcctgatcttttaatctgcgattcaaatcagccacaagtaaatcaacaattccaccgatattctcttttgtcaatggcttgaacattataatttcatccagacgatttaaaaattccggtctgaaatgagcacgcagttctgcatctactttgtcccttgcatcctgactgatttcaccattttcttcgattccatccaacaagtaaggagaaccgatgttagatgtcataatcagaatcgtatttttaaagtctacggtacgtccctgtgaatctgtgatacgaccatcatccaatacctgtaacaatacattaaagacatcaggatgtgctttttcaatttcatcaaataaaactacggaatatggttttcttctgactgcttcggtcagctgaccaccttcttcgtatccaacgtatcctggaggcgctccaattaaacgagacacagaatatttctccatgtattcactcatatcgatacgcaccatgttctgctcatcatcaaacagcgttgccgccaaagtcttagccaattctgttttaccaacaccagttggaccaaggaacaggaatgaaccgattggttttgttgggtctttaattccggctttggaacgaataatggcatctgttacttttgtaaccccttcgtcctgtccaatgacacgtttatgcagttcctcttccagaccaaggatttttgttttttctccttcggtcagttttgctaccggaataccggtccatcttgaaataattcttgcaatttcgtcatcggttacactttcatgtaccagagataaatcctgatttttcactttttcttcttcgatttcaagctgtttttgcagctttggcatttctccgtactgcaatcttgctgcctcatcaagattataatctctctgcgctttctgaatttgtttattcatatcctcaatctgctcacgcagtttggataatttctcaacggaagctttttcattatcccactgggcttttcttccattaaattcatcacgcagttctgccatttctttctgcagttccaccagacgatcctgacttaaacggtcattttcttttttcagcgctgcttcctcgatttccatctgcatcagtttacgatttaactcatcaagttctgccggcatggaatcaagttcggttttaatcagagcacaggcttcatccaccaggtcaatcgctttatccggtaagaaacgatccgaaatataacggtttgataatgttgctgctgcaaccagggcgctgtctgtaatctttacgccatggaatacttcataacgctcttttaatccacgaagaattgaaatcgtatcttcgactgtcggttcatttaccataaccggctggaatcgtctttcaagagctgcatctttttcaatatactgacgatattcatcaagagtcgttgcaccaatacaatgcagttcacctcttgcaagcattggttttaacatatttccggcatccattgcaccttctgttttaccagcacctacaatcagatgaagttcatcgataaacagaatgatttttccttcactctttctgacttcttccagtaccgcttttaaacgttcctcaaattcaccacgatattttgcacctgcaaccagtgcgcccatatcaagggcaaaaatctttttatcttttaagccctccggaacatcaccttgtacaatacgctgtgctaatccttctactgctgctgttttaccaacaccaggttcaccaattaaaaccggattgtttttggtttttcttgaaagaatacgaatgacatttctgatttcggcatcacgaccgataactgggtcaagtttctgctgtcttgctttttctaccaaatcctgaccatatttatttaaggtatcataagttgcttccggattatcagaagtcactctctggtttcctcttactgtactcaatgcctgtaagaaacgttcccttgtaattccatattcctgccagaatgatttcatagtcggactcgggttatttaaaagagccaaaaataaatgttcaacagagacatattcatctcccatcgctttggcttcgtcctccgcactgaccagtgctttatttaaatactgaccaatatactgctgacctccggacacttttgttctggcatttaatgcctgttcaattcgattcaggaaatgctctttctgaatctccattttttcaatcagcttcagtatcaggctgtcctcctgatgcaccaggttgtaaaccagatgctcctgctcaatctcctgatttccaaattcataagcagtcttttccaaatcctgtactgcctgaagtgatttctgtgtaaatttgctaatgttcataaaaatccctccatctatatcaaaggctattgttttcttgttctattgcaaatataacactatttgttagcactgtcaagaggtgagtgctaattttttaatattttttttgcaaaccttgattttacgggtttgcaacaatttttctatctgcacctgttccttattaagcggcacttcagcaccattagtgccatcatttgcaccacaattaatgccaataacgccatttttggtgccattggtgtcaatcatggcgttattggtatcaacctaatctcgataagtattcatacgctctatcgtttcagttattggtaatttccaagagccttctctatatattcctgtcttaattcctctgccagatactcatcgctcatacaatgcatatcagaaacaccgtcacgaatcagctgataaacctgagaatgataaaggaaatccaacgccgcatccaatgaaagtccctgctgtttagcaaagcattcgataacacggctatattttttctggagcaaaatcggatttgctgtcatagtgtttcactcccttcaaaatacaacaaagacaatgatttctctgtacgaaaacaaatttgcaggtttggtttttcgtaacgcaaacggttgatcgcttctatcttatcaatcagtccgtcaaagaacagctccactgtattgaacaccttattattgacaacaccgcccactacaaggtcataatctgtcgaatcttttccactgcggcaattcaaaataaaatccaaccactcctcggaataggaatcaaatttcagtgttttcagttcggcttctctaccttcatcgtattcatactgggaaataataccatctttccctcggcgtttaaatttgccacaccacttcgctgcctgttcatacagcggcgtgacatagacctttcgctttcaatgtcagattcttgttcttgaaatggtgattactcattaccgtaaaattctttgttctctctacacgaaaaatctgtgccatgctcccatcctcttttttccgtttcgctacgcagcttataaccgggaatcttccagaattttcttacatcccctccccataaattacaacactgtagcctttctgctttttgctctgatacattgccccgtcagcctttctgtatagctgttcaaaagaagtctcttcatatccattataaaaacacgcaccaagacttatttctatactctttcccggcatctctatgacatcaatctgtcggatattttcaaaaagtcgttcaaaaaatttctcagctactgttcgctccaacattttcggcataaatattgcgaactcatcacctccaagccgcaaaaccacatcactgtcacgacatgttttccgtaacttctccgcaacagctataatcaccttatcccctacagaatgcccgtaagtgtcattgatggatttaaatttgtcacaatcgatcaggcaaaacaatcctcccgttttttcctttaaaagttcaataatccttttttctccgcttccacgattatataatcctgtcataagatctgtccgcgccagataaatcagcctgttctcacgctttttttcttcttctatacactcaatacagaaaagcacatgcagaagtcttccattttcatcgtagtctacaggaataaatctgcttcggcaccaacctgatattttatctataaattcatgtgttatgctgttttccccaagaagccgttcttccatcgtactgatatctagaaactccagtgattcctgaagttgtgattctatacatgttttctcagcaatatcattgatatatccgcaaaaatcatccctgactttatattctcccatttttttgaaatcttttcccaaacattccagaacctgatctgtcatttttacaatatgatatcttttggtctgcacatcaacccaatacatagatgtatagattttcgagagggatgaataactgctgagttttgcctctttatttgactttataaatgaattacgcaatttcagaaatgaaataagaagcgttcctatcatatccaaaaaagtagtaagccccctgtaatcactctttggaggattatccacaccaaaaaagccacttatctcatctttataacgcaaagggcataccaccacatttctcacattctgcgcttttaacatatcatacgatgcgcgatgttcttctttgatatcttctatatcagtgatactgatactttcgcccttggaaaacgtatcataccaccattttatcacatccatatcgacattctgcaatctgtctatctcaggaattactccttccgcgcaccattcatacgtattgtctgtgccgtgcctttctttacaatcctcaaaaatatatattctgtcagaaccgatatgtctgccgaaaaagcggataaattcattaatctgctcgtcaggtgtgtggtaattgagtgcagatctaagtgcttcatttatgaccagttcatactttatgattgtcttcatgttattttcctcctgaatgtctttcttatcttacttttttacattcaaaccagacggaaagaccttcttttattttctgctcttccacaggtttcataaaaaaatattctatccgaagcctgaacgcatgaagcgaaaaatcaaggtcactgcaccagatgattccacatttcggatacagggaacgaaggtgttctgctgcattcaggccggacactcccggtaatgcgagaaacaccactgtcggtactgttttcaatgtccgtgcaaaaaattgttcctgattctgataaatttcaatcaacggaaagacatgcttctctgtacagtaattcctgatatattccgcactgttttgtccttcctgttcctggtcggtcaatatggcaatacaatacacaatacccctccctttctatttcatgtactttcatttgttattctcattataagaaagccagaaattatttcaacaattctggcacgaattgacagaaaatggcacgaattgcaactccgtggtattgttttgtgctatactgttaccagagcgttttcgaaataactacaccacttgcctgtctgcggctatagattgcgcagatgaaaaagtctcagcaagcggaatttacttttgacactcacatcatttcataaatatatataaggaagagctactatgaaaattgcaatcgttgatgatatttcagacgaacggacactgctacgaaacagactggaatctcagttttccagacgcaatgtccatacagatatatttgaatatgaaaatggagaaactttcctcactacagcgaaagaatgccctttcactgtagtgtttctggatatttatatgaatggatccaatggaattgatacagcaaaagaacttcgcagatcagacactaactgtctgctgatctttacaacaagttcaactgaccatgctctagagggatttcaggttcgagctctgcactatcttgtaaatccctacagtgaaaatgatatttccgcactggcagatgaaatcctttctcgcatcccggattctgggaaatacatagatgtaaaggtaaacggcagtaatattcagattcccttccagaaaataatctatgctgaacatttttctcacatgattcacatccacactgccggtgaaagggaactgatcacccgccagtcctttgattccttcataacctccctgaaaatggattcacgtttctatcagtgtaaccgaggcgttgtaatcaatctggagcatgccgttgattttgacgactcaggttttcgccttgataatggaaacaatgtcccggtcagccggaagctgctcaaaaatgccagacagacatttatggaatttctgttccaaaggaggttctgaaatgactgacatacttcaacctgtacttgaactttccgtaatcattcccggcgtactgctagcatatctgcctgtaaaaagctatctaagacagacaccgcttaagctgacagcgtggcttcttcctcttcttctgggaatctgtattttcgggggagcagtttgctgtgccctccaccttcccaccagacggatcctgtttcctctgctgcctgttattatgcttatttatcataaaacattaaaaatctctgtctggaaatccgccagtatttttctggcagtctttgcagtttttgcatgtatcaacagtctttctcgggcagtcaatgcacttataactgctgacctgcctattacagaaaataagctgtggtttcgtaccggtgccggaattttctataacgtcatctgcctgctgtttgttctggcagcatggtatcctgtccgccactatgttcaaacaatgatcgcagacgaaaactttgcccagacctggtatgtattctggattcttccggtaatcttcatcggagtgaatctttttatgattcctaaataccgcggcactttatatactgggcgggtcctgcagtgttatattgttttaagtcttgtactgctcataatcctgctcctgttttatgtcatatttcttatgatggcagctagcctgaacagaaatgcccgacttcagcaggagaaccattttctttcccttcagcaggaaagatacgagaatctctgcatggccattgaagaggcaagacaggcgcgtcacgatatccgccatcattttgttcaactgtcctctctggcagagcagggtgacatggaaaaggtcaaaaaatatctctttgctgcaaccggaaaaatctctgactataacctccatttctgtgaaaatcaggctgttgacagtgttttcggatattattccacccttgccaaaagagaaaacattccttttcatgcactggtttccctgcctgctgatctttccatagatgagattaatctgtgccttgtattttccaatctgctggaaaatgccatccaggcaagtgtgaaaacagagcacgcccgcagaaagattaatgtggaagtttatcctcaccataatcatctgcttctgattcatgtggagaataccttcgatggcaaaatacagcaaaaaaacaatattttccaatcctccaagcgctccggaaacggcataggaatcgaatccgtccgccacattaccgataaaaacggcggtgcctgtgactttacctataaagatggtattttttctgcaaaaataatgctccgggtataatcagtaactgattatacccggagcatccacgactgccgcactttataagattattctctcattccaaccaacactttttaccttcaaacacaaatccataatgtctgatttcttttcgctcaaatccccgagcaaataattgtacataaaaattcctgatttttaattctttttgcgatttgcccgttccagataaagaaagaacccaatatttaaaataattcccacgattgtggatatcggtgctgccagaccaattttggtcaggcttgcatttggctgaatactcataaaataggccagtggcagacgtactaaaagcgtctggattaatccctgcgccataacccaaagcgttttattatttccattaaagtaaccaatcatactaaaaagcacagccgttacaattgtctctaatgcaaatcctttcaggtaatcataaccattttgaataaccgcagcatctgtcgagaaaaatcctgccagtacatcccctttaaacatgacaagcaaaaatacaacgcatccaactgcaagtcctacgccaattcctgtaaccatagatttctttgctctttttgtttttcctgctcctacattctgagaaacaaaagaagccatagactgcattaaagcacttggtacaagcattgcaaagtttacgattttgcaggcaactccatatccagaagaagcttccagaccaagtcggttaacaaaggcacataatgcaaggaaagaaagctgggttaaacattcctgaagtgccaatggtaatccgattttaaggaattttttacactgcggattaaatcggaaatcgctctttttaattgcaaatggaagctctttctttaatagaagaatcactgcaaatacaacgctgagtgcctgtgccataactgtcgcaactgctgcacctgctgcatctttatgtaatactgcaacaaaaaacaaatctccgattacatttacaatacatgcaaccaacacaaacaaaagtggagatttgctatctccaagacctctgaatattgcagacatcaggttataagctacaataaaaaagataccacttccgcaaattcgcacatactgagaggtcaaatcaactgcctctgccggtgcctgcattaaaacagaaatcggacgtgcaaaacataccataataataaataatccaattgaaatcagagcaaatacaacaactgcaccaccaataacagctccaatctgctgtggttttttctcacccagataccgtgcaatcaaaaccgtaatacccattgcaaactgaatcaccacaaatgtaaccagatttaaaacctgacttcctgtagaaactgcagaaagtcctgaagtcgaaccaaatcttccaactaccagcaagtcaactgctccataggctgcctgtaaaatcaaagctccaagtaccggcagcataaaaaatactaatttctttaaaatactcccttgtgtgaagtccgctttatcattcattctttatctctcctctcacacatcacctgataaaatttctcaattactgctatcatacaatctgcttcttcttccgaaatatctgccaaataaggagccagctcattaaaatatttctcattgtatttttcagatagcttctttcccttttccgtggcagataaatagataattcgtccatcctccggtgagactgtttttttgatatatcctttttcttccatttcttttaccgtccttgtaacaccgggtcttggaagatttaatttatcactgatatccgatattttcacctgaacttcttttttctctaaagctagaatcacgtccagataatgaatataagacggagcaactccatttggaagtgccggaagtaactcacggatacgttttgcctgataacaggcatctaacattcgcttaattttttctgttgtcatctctcactctcctttttaaattttagttaccgacgttaattaccattgataattatacagatattttcctcattgtcaattcatttttttgcttgcccgaaatttttctttgtgctactattttcttagaaatttttctaggaggaattttaagatgagcgatgtattagaacaaatgaaaaccagaagaagtgtcaaaaaatataaaccagatatggttccacaggaaatcattgacaaagtgaccgaagccggactttatgcggcaaatggaatgggccgtcaggctactattatcattcaggtaacaaacaaagaaatgcgtgacaaactctccgaactcaatcgtcaaatcggtggctggaaagaaggatttgacccattttatggtgcgcctgccgttttagttgttcttggaaaaaaagactgcccgactcatgtttatgatggcagccttgttatgggaaatttaatgcttgctgctcacgaactcggagttggaagctgctggattcaccgcgctaaagaagaatttgaaacagatttcggaaaagaactgttaaaatctcttggaattgaagacgaatatgaaggaatcggacattgtattcttggttatccagaaggagactacccggaaactccagaaagaaaagaaaatagagtatttacaattcaataatcattaagggtgtagaagcaacagactcctacaccctttttagtggatttttaaagcacattttgcaaaaaccaacagataaatggcaatgtgataatcgaacaaatcgtggtaataaataccccacccattgcgtaatctccatctgaacctgaagtatttgccatcatcaccaccgatgtcataaccggcatccctgcaatcaatgccattgttaactggatttccgatgaaacagaaaggaatcctaaaagaacaaacaacaaaattggtgccagtatcatttttgtaagcacgattccatatagtgcgaattcttttagatgttttccaatgtgaatacttgcaaaaattccacccacataaatcattgcaagcggtgacgccgttcctcctatcttttgaagtcccatatccagaatccgtggctctttgatttcagttaagaccagaaatactgcaagtaaaattgcaaccgttgccggattaactaatttcttcgggttaaattttccttctccttgcggagttgtaaattttactcccaaagtccaaagcataaactggtctattatcgtaaatactgaaatatataaaatgccatttttcggaaaaatgcttgtaataatcgggattcccataaatcccacatttccaaacatcgacattgcctgatagattcctgctctgtctcctttcaaatgaaataatttcgtcatgccaaatccgcaaaaaagcataaaaaaataaaagccggcagtaataaacagtatcaaaacagaatgaatcaatgtttctttttctactccatctgtgatatttacaaaaaccagaatcggtaacgccatttttactacaaatctggaaatggcttcaagcatttcactgcttaataccttcgctttgattaaaatcacgcctgccagcagataaataacaaacaaccccatctgttccagcaaaatttcaaatgtattcattttctcttttcctctcatttctttccctactaatctatcgcattttgctattttcgtcaaattggcctttgctatttttaccgagtttttgtatacttttcttatctataagacgtttttattctaaacaaggaggcatttttttatgaaggaatacgaaatttttatcgaaactatgaatccctgcggtggcgcaaaatatgccaaacaggaaatcatcgaagccgaagctgaaagcccggaagcttatatcaaagagcatgcgaaatatcctgttcttgagactattaaaaatgcggatggagataccgttgttacgacagggaataagaatgggtatttgattcggtatacgtttacggagtgaataaaaaaatcgtgaatcagctcttcccctgattcacgatttttcatttatttttttcctaaccaatacggttccatatatcctgcttcacaaagatttccaactccctgtcctagtccggcagaagacaccggagcttcaaaatcctgtgtatttccatctgagccaatatagcggatacattttgtttcgtcatttggagacatgtagaatcgatattcttcctgtcccttatagacaaaggcaaacaacagagtattattttcatagtaaaattcagcggaataatcctgaggcaaatccgataaagttccagaacaggctccattttgagagacaatcttttttagatttccattttctgtatagattgccagaccacttgtgctttcatctttattataattatttaacttgccttgcgtatcataataaacatcacggatatgctgaatcatttcctcctgtgtctgtccctgtgcatcccaggtacttgttgtctgatttggctttgttgtcgtatccgtagcctgattcgatgaagtggaagtctctgcattgctctgacttacttcttcagcttctttctttgcctcctctgcctctttagcttcctgctcctcatattttttccatagttctttttgttcttcttcctctttctttttttcctcttcttttttcttttcgtcttctgttttttcttcctctgctttcttcttttctacttcttcagactcttctttcttttcgtctttgcattcttctgttttgcttaccaactcttcctgctgctgcgcttcctgtttcttattttgaatcaccattccggttacaactgctcctgcacaagctgcaattgccagaatcgcaatcaatatatacagcccaatacgttttttctttttctcttctactaaagctgtaccacaaattttgcaaaatttctggttttcatcatactgctttttacattttggacaaatcttcattttctttctcttttcacctcaaatatttttacctataaaatacggctgtattatatcacaattttttcaaaaatcaaatctgttttcttttctttttctaccttataataaacttgctaaaattgacattcaagtagaaaggattttaatcatatggaacaatttctcgcaggttttgaggcattaaaagccaacatctttgataatatgattgaacaacaggctaaacttggttatcgtaaagaacctgtccgtctttactatccacttagctctctcaaccatttttttaataaaaaagcagactcagatgaaatgcagcagatactttcggattttccggtttatacaaaagaacaatgtggagaaatttctgccacacataaaggagaacgcttttgttttaccatctccgaagaggtttcggagtatgttcacacaaataaacccggcaatatttttatttgtgaattaatccagcttttaacaaagcatagtacaactcttgaagagataattacgcttttcaagtctcaaccaaaagaatccgttatcgaaccagtcaacaatggagaattcgacattttaattcgttttgtaaatgataaagaccgctattactattgttttaaagatgaaggttgccatattatctatcatcggttcttaccggaagattacgcagatttcgatttttaacaaaacaaaagagcaggagaacttcccattctcctgcccttttttaatttacagaattttttttatgcatctatctgatttaataagttcaccatttcaattgcagaaagtgcacagtcatatcctttatttcctgctttgcttccggctcttgcaatcgcctgttcaatattttctgtcgttactacgccaaataacaccggcactcctgtctgtaatccgactgttgcaattccttttgaaacttcattgcacacataatcataatggctggtatcgcctcgaataactgcaccgacacagataaccgcatcatactttccggattttgcaagacgctctgccacaagcggaatttcaaatgctcccggtacccatgcagctgtaatgttttcttcttctactccatgtcttaccagtccatctactgctccgccaagcagtttatttacaataatctcattaaaacgagctgctacaattgctgctttcattccttttttggctactacttttccttctaatacattgatttctttcatgattttttctcctttttgtatgcctatgattttattgttttccagctaaattaatttaaaatgttttgaaacacatgtcccatgcggatttttttggtttccatatagcgtctgtcatactgctgtgttggaatttcaattggcactctcttcttgatttcaagtccaagtccactcaatccgtaaatctttgttggattattggttaataatcgcatggatttaactccaagatcttttaaaatctgtgctccaacccagtattctctcaaatccggcgcaaatccaagtttaatattcgcatctaccgtatcatatccttgttcctgtaattcatacgcctttaacttgttaatcagaccaattccacgaccttcctgacgcatatataatacaattccgcgaccttctgcttctatcatctgcattgctttttggagctgaggtccacaatcacatctaagagagccaaacgcatcaccggtcagacattcggaatgaatccggcaaagcacatcttctccatccccgatgtcaccttttaccaatgcaacatgatgctcctttgtgatatcatttacataaccgtaaattttgaaatgtccatatcggttcggaaaatccgcacacgcttctcttaacacatgtttttcgtgaattcggcagtaatcctgaattgcctgaatcgtaataaattttaattcaaactttttggcaagctcccaaagttcacttgtgcgcatcatcgttccatcttctctcataatttcacaacacacaccgcattgttttaaccctgcaagacgcatcaaatctacagttgcttctgtatgtccatttctcaccagcacaccgccgtttttcgcaatcagcggaaatacatgccccggctttctgaaatcctctggcgaaacgttctcatccacacacatccgcatggtaagtccacgctctgctgcggaaatgcctgttgtcgtatctttatagtcaattgaaaccgtaaatgcagtctcatgattgtcggtattttttgttaccatcggtacaaatccaagtttttctgcaagttctacactcatcggagtacaaataagtccctttgcataactcgccataaaattaatattttcctgtgttgcaaactcggctgcgcaaatcatatcaccttcgttttctcgattttcatcatccgtaacaagcacaattttcccttgttttaagtcttctaacgcttcttccactgtgttatattcatgttccatttccgttttcctccctgtcagattccgtatttttctaaaaattccattgtcaaatttgaggatgactctgattttttctcttctgtttctttaaaattcaatagccgttccacatattttccaatcacgtcgttttcaatattgatacagcttcctgactttttatcagctaatgtcgtttcctgtctggtatgtggaattactgaaactttaaatgttacatcatttacttctgctactgtaagactgactccatcaagacacaccgagcctttttccacgataaattttagaatcggtgcatctgcttttattgtaaaccagactgcattttcttccggcaatatctctgtaatcacaccacagccatctacatgccccgacacaatatgtcctccaaaccttccatttgctgacatcgccctctccagatttactcttgcacctgtttttgcttcttttaaactgcttcgccttacggtttctgccataacatcagctgtaaaaaaaccatttccaagagtagtcacagtcagacagattccattgacggcaatgctgtctccgatttttgtgccttccaacactttttttgcctgtatttttatacttccggatgagccggaaatgcttaatttttgtatgatacctgtttcttctacaattcctgtaaacacttcggtacctccttccggtaagtaagctgtacgtcttctccaatttttctgatgtcctgcagataaaattcttttgcgtcttttacctcacagattccacatccttctacaggggaaggtgcaccttttccaccaaaaatctttggtgcaagaaatacatgaacttcattaaccagattttctctcagcatgctttcatttaatgtaccgccaccctcaagcaaaatactgtcaatcttttgttctcccagtatctctattaattttttcaaatcgactcttccttcttttgaaacttccagcacctgtactccaagcatttccaaatctgcttttttctcctgttcggcatcggcacaagctatgattgtcggatactcttttgcactttgacaaatcttactttctaaaggaatctgaagtttgctgtcacagataattcgtatcggacttttctttccttcgattcttgtatttaacatcgggtcatcttttaaaacggttccgattcctgccatgattgcagtatattgatgcctcatttcatgtacgatttttctcgattgttcggaagtaatccattttgattttccggtttttgttgcaatttttccgtccatcgtcattgcatatttcatcacaatataaggtcttttcatctgaataaaatgaaagaataccggatttaattcatcacattcttctctcataaaatcctcttctacctcaattccctgcgctcttaaaaaccggactccttttcctgcaaccaaaggattcgggtctcttgaaccaattactactttcttgattccagcttctgcaattgcttcggtacaaggcggctgttttccataatgacagcatggttcaagcgttacatatatcgttgcaccttctgctgattcttttaaatgtttaattgcattgcgctctgcatgcagttctccgtatttttcatgatatccttccccaatgatacgtccatctttcacaataaccgcgcccaccagcgggttgggacttgtccatccaactccttgctttgccagttcaatggctcttagcatatattcttttttctgcattttctttctcctaatcgaaaaaaatccctgcaaataaaaagtttatctacagggatttctcatatttctaactatatatgaaacaaaaaggctctgaaacggaaatccatttcagagcctgatattcatgattttgattttttaatcagtcattcatttctcttcttccatccagactttactgtcggtatcggaatttcaccgaatcatgcctttcaaatttattttttcaggctcgcagactatcactgccggtagggaatttcaccctgccctgaagatttttcttatttacttgattaaaattatagtacaacaatttaaatttgtaaagtgcaaattttaaatttcttccagcacaatttcaaaagagacatcatctccaaccgctctttgaagtaaaactcctccactcatcaaagcaacacctgtgtacacctcttctgttccggcaatcttataatttttcttagcttctaagcccattagacgcagagtctttcttaatacatttggtttcgcacggaacaatacaccctgaaccaatatggttttcttatcttctgatatccaggaccatgctgacatcccatcctcaaatggatttgccagacgataataatcaccgttataaatcaaactttgatattctttataatgggtaacctgttttgcaacaactgttttttcttcttctgaaagctgatttaagtctaattcatatccaaagcttcctgccattgcaaccacacctctggtttcaattgaggtaattcgtcctgtctgatggtttggcactgcggaaacatgagaacctactgttgaagttggatagaagaaacttgtaccatactggataaaggttctttcatgtgcgtcggtatcatcactgcaccaaatctgtgggcagtagtacatcattccggcatcaaatcttccgcctccgccactgcatccttcgaacaatacatccggaaattctgatgtcagtttttcaagcaattcatacagtcccagcacatatctgtgtggcatttccatctggcgtcctctggaaagtgtagctgtataccagtcactgatactgcggttcatatcccatttcacatattcaatatgattttctcttaaaatcgcactcattacaccataaagataatccaccacttctggatttgacatgtctaatactaactgataacggcttctcatcggctttcttcccggaatctgaatcgcccagtctggatgattacggtacaaatcactgtcctcggataccatttccggttcaaaccaaagtccgaatttcatacccattgcattgattttctcaaccagggcttttaatccgccatttaatttcttttcattgacaaaccagtctccaagtccggaacaatcatcatctctctttccaaaccaaccatcatcaagtaccatcatatcaattccaagcttagaagcctgtcttgcaatatttaaaatcttttcttcgttaaagtcaaagtaagttgcctcccagttattaatcaaaaccggacgactgcttaactggtatgttccacggcagacatgatttcggatgatgtgatggaaattctgagacaattttgcaaatcctgttgtagaacaagataaaatcacttccggtgtgtagaacgcttctccggcttctaaggtccattcaaatgtgtctggatggattcccataaccaaacgaacctgttctaactggtctttttctacctgtgcctgaaatcctccgctgtacatcaatgcagctccgatgcagtgaccatttgtctctgtacaatctttttcacaaagcagaacagccggattttgatgatgactggaagttcccctgctgctgctgctctctgaaattccgtgcaaaacaggaactcgttctgcctgtctttccatagtatgtctgccataaaaatgcatccattcccagtctccatacggaatatccagacacatactatgcactttattaattacaatcggtgttttccctgaattttttaccaccacacttcttgtaatcacgtcttctttttcaaacacaccatacttcaaaatcacctctgcttccgttgcagtatctttcaaagtaatttctaatgtttctgcttcgtcttcttttgcatacactgccggaagccctggaatctcatattttccttttttaatctgatattccctgactcttaagtctaaagcattacttccatcttcatgagtaacagaaattgcagagattcgaaaatctccaactccgctggtgctgtattcctgtggcagagtatttaaagaataggttctttcattttctgcttcatagatatttccggaaaatcctgcgtccggataatccagaagataatccatacaacaatctgttttttctccataccagagatgattgagtactccaaagcgatccaccttcatctgataaagtgtgttttctgtttccaggttaaaaattttgtcctttactgtaattgccatacgttttcctcctaaacaagatttttgttttcactgtttgctctcgtatcttactttctattttaaccttttacagctccatttgctaccccatttaagatttgtttctgacataataagtagaaaatcagaatcggaattaatgcaagaatgtaggatgcaaatgcaagattataattcgtaccaaactgggtctggaaattcagctgtgccagtggcagagtatttttcccggttcctgacataataacaagtggagtcattacgtcattccaggttccaagtgccgttaaaatcgcaacggtcgcatgcattggagacatcattgggaatataattttccagaatgtctgccaggtagttgccccatcgatagaagcagcttcttccagcgtttccggtatattttttaaatatcctgtgtataataaaatattcatcggcatatagaaaaccagataaagaagtatgacacctaaacggtttccaagtcccatctgtgcagtctgttttacaagaggcatcattaagattgcaaatggaacaaacataccgctgacaatgtaaagatatataaatcgaaaggcctttttatgtgccatacttctcccaataacgtaacctgcaatagaatgaactaaaattgcaagtccaattgtcacaagtgtaatgagtaaactatttcccagagagttccagaaatctgttactctcattgcttctttgaaattatccagactccagcttgatgggaatgccagtgcacctgccacatcatttgtcatttcacttggctttttaaacgcaataatcactgccatgtacagtggaaaaaatactgtaacggttcccaaaatcaggatagctgtcaaaatacgatttacttttcctgtttctttcattataattgctcctccttcttatttaagactgtcatctggaatacagaaattgcaacaatcacaacaaaaaataacactgcatttgcactctggaatccaaactgtccgccatccataccatttttgtaaatcaaataagaaatagattccgtactctgtgccggaccgccttttgttaaagacataatctggtcaaataccattaacaggttctttgtgctaagcaccagattgatagttacaaacggaataacaagcggaagggttacactgaaaaactctttccatttgcttgcaccatctaacatagatgcctcataaacttcctgtggaactgtctgaagccctgaaatgtagataatcgtattcatagcaactgcctgccatacaccaacaaccagcacaccaatccatgcatttttttcacttgccaaaatactgttttgaagccatccaatatgaagactggttccaattcccggaaggatgtaagtaaaaataaagctgaaaatataaccaattaccagtccgcctaaaatattcggaacaaagtaaattcctcttaaggcgctcttaaaacgaattttgctgtttaatcccagtgccagtaccagacttaaaaaatttaccagtattgttccaacaatcgcatatttaaaggtgaacagataactctttccaacacgtgcatcggtaaataaatcaatatagttacgaaatcctacatattcatacgttccatagcctttataattggtaaaactatagataaaaccttttatcatcggcaatgtattaaaggcaaagaacaaaattaaaaccggaataataattgcccagaacgttttatctttatttgtcattttcttcttcataacaatctgtcaaactcctctcttatttctgtttttcctgatagtcctgcattttccggattaaatcacggttgtatctctgccagtctgtatcaaaacgcttcaggaaagtatctaatgcattttcgctgtcatctaacaaataagtctgtaccatcgcatcgacactcatctcacttggataatggtggtcatggaaatccgccattcttccttcttcgatatagcttctcatatcttctaattccggtgccagttcaaaatcaccttctttacatgcaattccgccctgatcatctaaataaatctgaatggtttcatcttcatataaaaatcttaatacttcataagcagcttctttatttttactttctttcagaacagaaaactgtaaatcaattccggagtttaacacattgtctgcttccgaatcatttgccggaaatgtaaacgaaccgatattcatatctggatttactgatttaatctgaggaatcgcataacttccaatcggatacatggcggcttctcctcttgcaaatgcggtacatgcgtcattatatccatatgcatatggattcggttccgcataagaaaccagctctttgattttttctgctgtctctctataagcatcagaaaaagttgcttctcccttattaacctgactgcaaatatcagaatctgtcagtcctactgccagagcattccacggtgccatacaggtccaggtatctttaaaacctaaatataatggctgtactccacttgccgaaattgtctcacataaagttgtaaattcgctccatgtagttggaatcttccagccattttcttcaaacatatctttattgtataaaatacctgctgcatttgccgcatacggaagtgcataacttccttctgtcggaatcagcttcaactcttcttccatatccagataagcctgttttgtttctttgagtacatctaagtctgataaatcctcaaacaaccctgcatctaaaaaattagaatagttcatatctccaccaattcctacaatatccggatagtcttcacggataaatctggtttttaaaattgtaaccgcttcatttggtgattcaattgttaagtgaatatcatcatgcgtttcattaaaccgctcttcaattttttcaaaggctgccactgcctccggcttataagaaatcatctcgacttctgtttttccatcggatgttttatttccacatccactaagactgactgcaccaagcaatatgccgccaagtacaatgagccctcttgccatttttttctttgccattctgactctcctccctgttcttctcttttttcttcttttattttaacatagcaatatgctacctatgaatcgcccgattctgctatttttatacccaaatgatagattttctgttataataaaaaagcaatatcgcattttgatatatattaaaaaggagcatcttttttatgagtaccgtatcattttctatctttccaaatgacaattttattgacctgtgcctttaccagtatggaaaagaacaatgcgaccctggacattcttttggacccgctacacgaaatcactatctctttcattatgttctctctggcacaggcacgcttatggctgataattcaaaaggaatcacacagacttattccgtgaaaagcggtcagggatttctgatttttccagggcagatcaccacttattttgcagaccaggagcacccctgggaatatatctggctggaatttgatggactaaaagtaaaagaagcccttcagacaacttttttttctttagaacatcctgtttatcgtgcaaattcaaaagagcttcgggaaatcttaaagaatgaaatgctctatattgtggaacactgcacagcatccaaattccatttaattggacatctttatctcttccttgacgcactgactcagtccactcattctaatgaactgacttccagcagtaaaatgagtgattattatattaaagaggctattcattatatcgagcaaaactttcaaaatgacatcagcattgaagaaatcgccggggtctgtggaatcaatcgaagttattttggaaaaattttcaggaaatccattggaaaatcacctcaggaatttttgatgaattaccgaatgataaaagcaacggagcttttaagcctgacttctctttctatttcagaaatcagtcaggccgtcggatatgataatccgcttcacttttccagagcatttaaaaatgtttatggaatttctccaagaacctggagaaaagaaaataagtaaaaaaaacgtggcaaagtctcatctattcagactctgccacatttttttattgatgcgctgtctttgtaataatagaataatattccggtcttctatcccggaacagtccccattcaagccgttttgccgaaagctcatcaaggtcatattctttctctaaaatttcttctttatcccttgatgcgcttttaagaagctctcctgtctcatctgttaaaaaagaagaaccataaaaggttaaggaagaggtctgtcctccattctcttcacttggttctaccgtttccagaccaattcgatttgcagcaatcaccggcataagatttgcggctgaatgtccctgcatacaccttctccagtgcggcatactgtcacattccaaaatcggttccgaaccaattgctgtcggataaaataaaagttctgcgcctaaaagtgccatgcttcttgcagtttccggaaaccactggtcccagcagattccaattccaattgtgccaaatctggtttgaaagacacgaaacccggtatctccaggtgtaaaataaaatttttcctgataataatggtcatccggaatgtgagtcttccgataaacaccaagaatcgtcccatcggcatcaatacacgcaatagaattgtacagattattgacttctttttcataaaaactgattggaagcacaactcctaattctttcgccagacgctgtcccatcagaaccgcttcgttttcctctaacggtttagcataatgataaaaatcataacgacgctgttggcaaaagtattctctttcaaacagttccggaagcaaaattatatttgctccatctcctgctgcctttcgtatcattttttctgctttttttctgttttcttctggatttttactacactgcatctgaattgcagccactttcacctgtctcattcttctactctctttcttccttccggaatctgctgtgtaatacaatgaatatttccaccacccgtcaaaatatctcttgcatctactgcaatgatttctctttccgggcaaagtttcttcattatttcctgtgcacgaacatcactttctttgttttctcccccaaattccggcatcacaactgctccattggaaaaataaaaattcacataagaagccgccagacgttccccttcctctctgacgtcttctccttcttcaaaacaatatccttccaattcttcttttgtgacacaaatcggaacatccggtatcggcagcttatgaatgaccagttttcttccctttgcatcacattcagactccagataatccagacatgcttttgataaaacatactgtgggtcatcttcattatctgtccaggcaaggactacctcacccggctttaaaaatgcacatacattgtccacatgctcattggtttcatccaggtaaatccctcttggaagccacaaaattttctctgctccaagataagatttcaacttttcttcaatctgctttttacttaactccggatttcttcctttgcttaacagacagctcgccgtgaccaaaaccgttccttctccatccgaatgaatcgaaccgccttccagcacaaaaggagctgcgtcataacattcatagccctgccaggcagaaaacgcttttgcaaatgcattatcaagcttccacgaagcataaagcccatcgacttctccgccccatgcattaaattcccagttaactgcacgcaccattctttcatttgctttatctgataccacaaaagtaggaccgatatctcttgcccatgcatcatctgttttagcttcaaacacagtaaccggatacggaatctgctttctttttaattcatttgcaaagttcgttgcctctgccacatcttcttttcttgcagctaaaaagactgcttcactccttgcaatcgcctctatgaccgctgcaaatgctttttttgcttctcttgcctcgtttcgccaggaacccggtctgcttggccatatcagaatgcagcctttatgtacttcaaattctccaggcataaaaaatccatcttgttttggtgtctgcatcttaatctctccgtttttttcctttcaagactgcgtaaagcggacattcgcaatccgcttcgctacttgctcatgaacgcagtcgcttcgcgatctgtcagtgggagctttcaactcccactgacagaagcatcccccctcacccgccgcttagtgctctgcgcacttgaagctggggaatgcttatctgcattcaaaattttcacgataagcgtcctttaaaatcttcataagaaaattcttttactatttccacttctccattttctttttttaatgcaattgcagggagcggcatcccattaaaggtattattttttaccattgagtaaattgccatatcttcaaaaaccaaacggtctcctacctgaatcggtttttcaaagctataatctccaatcacatcacctgccagacaagtcatagaagagagtcgataggtataaggttcttcacccggctgatatccattttgaagtggcgggcgataaggcatctctaacacatccggcatatggcaggctgcagaagcatctaaaatcaaaatctgtatttcattttttacaatatccatcacttccgtcacaagataacctgcatttaaagcaaccgcttctcccggttccaaatatacttctacgtcatatttttcttttatcgagctaatcagttttttcaaactgtcaatttgataatccggtctggtaatatgatgtccaccgcctaaattcaaccacttcatctgttttaaataacagccaaatttttcttcaaatgctgcaaatgttctgaccaggtcatctgcattttgttcacataaagtatgaaaatgaagtccttcgattccatccagatattcttctttaaattcactttttactacgccaagtctggaaccgactccgcatgggtcataaatttcatgcccctcctgggtagaacactccggattcacccgaattccaacgctgacatttgattcttggcaaatcaatttatgtttttcatattgggaaaaagagttaaaaataatatggtcgcagatttttaccaattcttgcatatcttctgttttatacgcaggtgcaaacacatgattttcttttcccatttcttcccagccaagacgtgcctcataaagcccacttgcagtagtcccgcttaaatagtttccaatcatcggatacaatacaaacattgaaaacgctttttgcgccagtaacacatgtgcgccggtttcctcttccaatgcatgcagaatctcaagattctctcttaattttgcttcatccactacatagcatggagtgggaattgcttcccacctcatcgtaccacttccggattttcttcaactacccatggaagtccatactcattcaacatttccataaatgggtccggatcaaactcttcaatgttgaagacaccgtctttatcccaaattttatttacaatcatagcagcacctatcatagccggaacaccggttgtataagaaattgcctgagagccgacttctttataacattcctgatgatcacatacattataaatataaattgttttctcttttccatcttttttaccggtgaaaatacagccaatattggtttttccaaccgtacgtggtccaagggttgccggatccggaagcaacgcttttaaaaattgaatcggtacgatttcttttccttcaaattcaattggtgaagtagagagcattcctacattttccagacatttcatgtgagtcaggtaactctgtccaaatgtcataaagaaacgaattctttttactcccggaatattttttgccagagattcaatttcttcatggtgaagcagatacatatctttttctcctacctgcgggaaattatattctcttttaatttccatcggttttgtctctacccaatgaccattctcccaataagaaccgtttgcagagacttctcttaaattaatttccggattaaaattcgttgcaaacggatatccatggtctccgccattgcagtctaaaatatcaatggtctcaatttcatcaaaataatgtttcagggcataagcagaaaacacactggttactcccgggtcgaatccacttcctaacagtgcagtaatctttgcttctttaaatttttcctgataagcccactgccaggaataatcgaaatatgccgtaaatcctgcttctttacagcgtttttcataaatctctctccattctttgtcatccgtatcttccggctcatagttggcagtatcaatatagtctactttacatgcaagacaggcatccataattattaaatcctgatatggaagtgccacatttaaaacagcatccggctgatattcttttattaaagcaattacctcttctgtcttatccgcatctacctgcgcagttgtaatcacagtctctgttgttttctgaagtttttcttttaaagcatcacattttgactttgtacggcttgcaacacagatttcagaaaatgttttgctgttctggcagcattttgtaatcgcaacctgtgcaactccaccacatccgataattaataattttcccatttttctacctcctgagtgttttattgattaatttttttcttcctcttctaacatatcttccacatatttcggaagcataaatgctcctttatgcagattcgtcgtataataccaggtctgaatttttcgttctttccatttttttgcatctaaatgttccaacggatggtacattttagacgcaaacccaaacagccaatatccggaagaacacgtcggaatatgtgcctgatagacacgactgattggaaaactatgacttgcctttcgatgcattactcgacaagattcctcatcttcatcataaaaagggcttccgtgctgatacaccataataccgtcttctcttaaggcacgataacaattcccataaaattctttagtaaatagccctgcattatgcccgagcggatcaatggcatcattaataatcaaatcatattcattttgctttaaacgcaaaaattttaatccgtcttcataaaagatgcgtactctcttatcctcaagtccacatgcattatccgggaaaaattttttacaaacctccacaaaaaccttgtccggctctaccacatcaatttcttcaatttcctgatagtgccctaactctcttgctactccgccatctcctccaccgatcaccaatactttttttacgtttggatgtacggccattggcacatgtacgaccatttcgtcatagataaactcatcttgctctgtaaatacaatgcttccatcagcacttaaaaatcttccaaactcatccgattcaaagacatcaattcgctgaaaatcggtctgctgctcaaataactgtttctgtactttaaccgacaactttactttttctgtatgataatccgaaaaccaaagctccatcttctttttctccatttcagttcgatttagactaatacatttaagtactctacttctgaatccatggttccttgcatggaacagcctttttcctttgcatacataatatattcgataatttcttttgtaatgcgctctccgggagctaaaatcggaattcccggaggatagcacattacaaactcactgcagattctgccttctgttttctgaatcggaagcgattctttcttagaataaaatgcagtctgcggagacatgacaacggttggctctatatattccatacttggcatctcttccggctttttggaatacaatcgcttaatatccgcaagtgctccgactaagcgctcgatatcctgaatccggtctccgattgaaatataagcaagaatatttgcgacatctccaagttcaatttgaatatcatactcatcacgaagcaaatcgtatacttcaattcccgcaagcccgatatctcttgtatagattgatagctttgtcacatcaaaatcatacacactgcttccatttatcatatcttttccatatgcataatatccaccaatggaattaatttcttctcttgcatattctgccatctgacttacctttgcaaaagactctcgtcctcttagagcaagattccgtcttgaaatatcaagacttgaaatcaaaagataagacgcactcgttgtctgagttagattaattacctgactcacatattcccaattcacattttttccggtcaaaagaagagaactctgtgtcaggcttccccctgatttgtgcatcgaaacagaagccatatccgctcctgcatccatcgcacagacaggaagattctctccaaaataaagatgcgttccatgtgcttcatctactaaaacaagcatattatgtgcatgcgccagctttacaatcgcccgcaagtctgaacagattccataataagtcggattatttactaaaaccgcaactgcatccgggttttcttttatcgctttttctacttcaaaacgttccattccaagagaaatccccaaccggacatcccgctccggattgacgtaaaccggaattgccccacatagaaccaatgcattaataacacttttatgtacattcctcggtaaaatgattttatcccctgctttgcaacaagaaagtaccattccctgaacagaagaagtcgtacctcctaccataaaaaatgcatgctctgcacgaaatgcctccgctgcaagttcttccgcttcttttatgacagaaacaggatggcagagattatctaacggtttcatggaattcacatccaaactgacacatttttctcctaacaattctaccagttccggatttcctctgcctcttttatgtcccggcacatcaaatggaacgactctttttcttttcaaagtttccagtgcttcatacaccggtgcccgcatctgccgatgctcttctttgttatttcttctgttatatttcatttctcctccgatgttgtgtcattccctctccaaaaatagaacgcaatttcctgtaaagtaagcaaaaaaaggacaggtaattccatcacctgtcctgtagtatcattctacaaaagtcattttaagtttatacactatgcatccttatgcatatttgcaaaaaccattttctttcagagcttatcgttgacgcttccgccagcaaatatttgctaaaactactcttattgaccgtttcacaagtgatatctctatctgagagggtcgcaggttactctcctgcacacaacttataaaatttgagcttctaactcaatcaataatgcggtctttcaccgcagtcggcagctgccccgcctgtccgtatgggcttaaccaatttcttggtgggcaaatatttgcatgaaaacaattttcgcattcatgtattttttagtataacataggttttttttaattgcaagaaatcttttatctggttaacttccgaatccactttccataattcacgatcaaaaatgccgggatacatttaaaccactgatccgcatttaaacagcacactacaatttgcggtgacgccttgaacacaaacgctgcaaggaaagaaatcggaagcacaatcccccagatactgataatatcaatctttgctacaatctgaggacttccgccgcctcttataattccattattggtcggcatctgataagacattcctacacagacggcacttaaaataataagaaaactgttcgccatcgctcttgtctcttcggataaattataaattccaagaattggaattcgcaagaaatataaggtaaccccggaacaaattccaattgctaaaaacagcttttggagttgcttggaataccgaatcacttgcacttcatctccctctccaactgcttttccaatgataacagaagctgtggagcacgcaccgactgctgctgatttcactaaaagaaacaggttggaggcaacactgttggccgcaattgcacgtgcagtcatatgacctaaaattgcagtttgaagtgcagtattgattccccaaaggctttgtaccaagaacatcgggcgtgttacttttccatagtctgcaaggatttctcgatccatttgctgaaagtaatcccggaatttcaaatctaagatcttttcttttcttatactataaaaaataacaattccacattctaagattcgagcgaccaaagttccaattgctgcacctgtcacaccaagcctcggcgcaccaaaccttccgaaaatcaaagtataattaattccataattaactactaacgtaacaatcgataacatcaaagcaatttttaccacctgaacggtacgaagagtagcaagcaaaattgtcgtaactgcaaaaaacagatacgtaaaccgaatgatggaaagatacacacagccttcctttacaattgcagtctctgttgtaaaaatatgcattaccgatactggcaaaaaggtcacaattccaaacaaaatcaaggcaattccaatcccaaaacgcattgcaacattgccgatttttttaattgaaccggtatcctttttgccaaaatattggctgcctaaaatgacggcaccttcagcaaatgcggataacatctgctgaaatataaactggatttgattgaccgctgtgacaccggataatgagatttcgctgtaagcgcccagcatgatattatctgtcaagttgacactaagcgttaacacattttgaagcactaataaaatataaattgaaagaaaatttttgtaaaagccccgctttttcatggttctttcttctcccgaatctcctcttcccatttatgtaattttcttgccgcttccggattttgcttttccagtctcttttcaagtctttccctgctcttcttcaagtgctccacaatctctggatgatgaatcaataactgctgctcaattttacgtcttcgtttttcaatcaattgcagaattactttgcgatctcctcttaagttttccggaagttcatctaaatgcaattccattcttcttaatatttcatcctcatcaattgctccaagcgaatgccagtttttaagtttttcttcaattccaagctctgcaaggcgctccaaatccggcagtttatgcagctgttccatcacctgatgcactttcttttcaatttcttctactgcatcatcaccaaaggcccaggcaaattcttctaaggtattttcctcttctgccggtatcattgcctcatggactgcatgcaccttttccgaaatttcaagcggacatggagaaggaattccggcatcatgcaaagctgcaagaatggttcggcggacttttccttcttcaattaaatgtccaattccaaggcttctcatctgttcatttacattttcggaatgttctgtgacataaaaatgaattccctgtttgtcaaagttttttgctatcatttccagacgatctgccgctgtgatatctatactgttgattgctcctgcatctacaatgactacttttgtatcttctttgatgctgctttcaatatcggactggaaaatcttaatgtttgcaaaaaacagattttcgctgaatcgataaataattgtatttttaatcggataagcattgcggtttcgttttaaatcataataggcttccttgcctggaatcataccataaaaagcacgaggcggattggttgctcgtaacacaactgctataaaagaaagtaacaatccgattacaacaccataaatggttcccaaaaacaaaacactgatgcacgctgctacaaatatataaaattcattccgacttactttaaataagcgaattgccagatgcaattccaccacattcataagtgctgaaatcacaatcgcagttaacaccggcacaggaagataaccgataaagccggttgcacagactaaaacaactgccatcactgcacctgctgtaattgaaactgcctgtgttttcccttcatactgctcattcattgaagttcttgaaatacttccattgaccggacagcatcccacacatgccgatgcaagatttcctgctgcgcacgccagaatttctttattttcattaattttatagccattttttaaggcaaagttattttctgataataaggtttctgacatgataaccgcagctatcatcagacttctccctgccgcctgcgtccagtcaatccctgcaaattgaaacatatgaatttttggaaggccactctctactgcatcaagcaaaatcactcctcgttcatccacatgaaacagcaacgttactactactccaaccgccataatcacaattgccatcggaaatttcggaatcagtttcccagccagccgaagaaaaaccaacgctccgactccaagtgcaactgacaaccagttaatttccttacaggtttcaaaaatatggtgagcaagttccggtaattctcctgaacccgccttacctcctaatatctttggtatctgcattaaaataattgtaagcgcaattccgctgataaatccccccataaccggtgttgaaataaaatctacaatcctgccggcttttagaaaataaaacaacaacagccatagtccggttaaaagcgcaatcacaggcacatactgcattgcctctttgcttccactctcaatcccaagtgaaacaagtgcggctcccacaatcgctgccggtgcagcatctacaccaaagataaactgttttgaagtagaaaacagtgcaaagaataaaatcggaaagaccgaaccataaagtccataaactgccggaagtcctgcaatttgtgcatatcccatcgaaatcggaatcgacaccgctgccataataattcctgaaaaaatatctttttttaagtattcttttttataattttttaatgtcggaaataataaacccttcatacgtttcattccttattattttgccatttcatagattgccagcatatctgcctcatataatacttttgcagagcccttatgtccgcctgtatttaaactgcatttatgtgccagttcttttaattcttcttcactcggagtcagccccagctcacgaagattggtcggcatctttatttcacggaaaaatgcctccattgcttcaattccacgcatcgccatctcttctgcatctccggtatcttcaagtcccattacccgcactgcaaatttgtggaaacgctctggaatttctctatagacatatctggcccagcttccccaaagtgctgcaagtcctgctccatgtgccacatcatacataccgccaagttcatgttccagtgcatgtgttgcaaaatcatttccaccgtttccacatccggttaagccgttatgagaaagacttcctgcccacattacttcagctctggcattgtaatcttttggattttcttttaagatctttgtattttcaatcactgtacgcatcaatgcttcggcaatgctgtctgtcagctccatattttcccctttggtaaaataacgctccattgtatgcattaaaatgtcggtgcatccgcatgcagtctgataatccggcagcgtcatagtcagttccggattcataatcgcaaacttcggacggcagtattcactgtgatatccggttttaatccatccatcttcatttgtgataacagaagaatcactcatctcacttcctgttgctgaaatggttaaaataacaccgattggcagacagcctgccgcacttcttttatgagaataaaaatcccatacatcaccaccatttgcaactccatatccgattgcctttgcagagtcaatgacacttcctccgccgactgccaggataaaatcaacaccttcttttttgcatagttcaattccttcctttacaagcgaaagtcttggattcggaaccactccgcccagttctgtatatgcaaggttttctttttccaatgcctgttttacgcggtctaacaatcccgtccgttttacacttccacttccgtaatgaatcaaaacttttttacagttttgtgcctttacaagttctcctgtcttttcttctgtgtcttttccaaatactacctgtgtgggtgcataataattaaagtgaaacatcctctgatcctcctgttattttcttactttttgagttattataagtataatacctgtgttttcagaatacaagttgactttacatttctattgtgataatctttttacgatttaagtagaaacaatacgggagcttgtgtgacaggctgagaggaagatattagcttcgaccgcacctgatttggataataccagcgtaggaaatcataagaatttataattttaaccatatctgctccggatttccaaatccagggcatttttactttattcaaaaaatttttataaataaagaaaggatacgctttatgaaaacagaacattctcacttacttcgcatggttatgcttgccatgttagttgccatcggtgttgtcatctctccgattctaagaatcgaaggaatgtgtccgactgcacattttattaacattgtctgctccgtgcttcttggaccttggtattcccttctatgcgcaactttaatcggaatcatccgtatgatgatgatgggaattcctccgcttgccttaaccggagccgtatttggagcatttttatccggtgtcttttatcgggcttccggtggtaaaatcatctgcgctgtcttaggtgaaatctttggaaccggaattatcggttctctggtttcttaccctgttatggcaattcttatgggaagaggcggtttaaccgcattttactataccccaatgtttttagctgctacgacaatgggcggaacagttgcctggttcttcttaaaaaccttaagtcaggcaggtgttcttgccgagtttcaaagaaatcttggagcaaaagtttatgataaaaaagttagaaaatctaaaagaacaaaatcgactcactaaacccctgattcactgcattaccaatccaatttccatccatgactgtgcaaatattgttcttgcctccggcgcacgcccgattatggcagaacacccgcttgaagtcgctgaaattacaagcaccgcacaggttcttgctttaaatcttggaaatattaccgatgcaagaatggaagccatgccgattgcattaaagactgcggtacaaaaagaaattccggtgcttcttgaccttgtcggcactgcatgcagtacgcttcgaaaaaattttgcaaaagaattactggaaattcatgttccttctgttttaaagggaaatatgtcagaactgcttgccatgatagaggaagaatcccacgctgtcggaatcgacgccggagaaaaagattccatcaccgacgaaaatcgaaatagactgaccaaactctttcggaaaaaagccgatgaatggaatacagtttttctcatcaccggaaaagaagacatgattgtatcaaaatatgagtgtttctttgtccaaaatggttcacccgctatggcaaatattactggaaccggctgtatgcttgggatggtctgtgcttcctatcttgcttctgcctcaaatgcttttaacgctgctctgacttcgactgttgaatttggaattgccggagaactcgctgcgaaaaagacaatggctcctgggtcttttcaggttcagctattggattccttctatcagttgaccgaagcaaaacgagattcacttgcaaaaacaatcgtgtattaataaaaagaggagacttttggtctcctcgaataatgattacagctctattttccgatctttgaaataatattccttgtcatgctcattgatttctcttatcaccttacacggtattccataagcaaccacatttgccggaatatctttggttactacacttccggcaccaattactgtattgtctccaattgttactcccggcattacacagacaccgctcccaagccagcagtttcttccgatatgaattggcatattatactgataagcctgcttgcgaagttccggtaaaatcggatgtcccgctgtcgcaagtgtaacatttggtccaaacatggtataatctccaacatagatatgggtgtcatctactgcagtaaagttaaaatttgcatacacattatttccaaaatgaacatgacgaccaccaaagtttgcatgaaatggtggttcaatataacagttttcgccaagttccgcaaacatctcttttaacatctgctgacgtttttctccctctgacgggcgggtctgattaaactcatacaagcgttcctgacatttttcctgttcttttaagatttcctcgtcccctggaagatacaattctcctgtatgcatcttatctttcattgccataaaaaatctgtcctttcgtttatctgcttttattataagagaacggcatacaaaaaacaatttatttctcttttatttttctgctgttaaaatctcgcacagtgctccaaacattgccggctctaattccattgaagctaatgttgcaatcgctcctttttgctgttctttgataagattatacaaatctgattttaaattataagaaatctgtgctttttctaaaatctcataagcttcctgggcaaggtctgccaaactttcttcgactggattttcaaatactacttttatctctgcatttaccggcacttctgttatttctatacacataccatttttctctactgttgctttatatgccgtctcttttccatctaccagcacgcttactgtatttttcttcatttttacaaaatccaatttccagcatcgtttttctggaagtaccttggtatttccctgtggactgtgaatgataaagcagtctttcccttcttcctgtgctttttccagctttgtttctacccagctttcttctacacagtctccttcatcttcccataacgtaaaacttccagtctttccagggaaaatttttatttccaaagattttggattatccgtgtcattatcaaatacttccatatttttcagtggaacaattgcaccttctcttgccagtaccggaatttcttcgattccacggaacaactgaaccatacgtccaccctcatattttcttccattaaaaaagtcataccagactccggacggaagccatgtctttgcttttccaagctgagtttttgtatctattttctctgtaatcggagaaaccataagttcactgccaaaataataattattcggtacctgataagcttcttctctctccggctctaaataatacattggcataacaagcggtttgccctctttattggcacagtaattcatggtatacagatacggaacaagcgcatgtcgcagttttaagaacgctttcataacagattctacaatcttattatatttccatggctcttttccattaaacggattatccgtactatgcagacggttaatcggagaaaatacaccaagctgtacccatcttgcggtcagttcatcatcacgatatcccatcatatgacctccgatatcatgactccaccagccataaccaatattgctcgcatttgctgtaaaatacggctgaaactgaagactttcccaggtaatcaccgtatcccctgaaaatccaatcggataacggtggcttccaggtcctgcatatctggaaaatgtcagcggtcttgtgcctttccatttattatccagataatgataatgattgagcatccacaacgggtcaagtcccggaacttttgttaccgttccctgctgccagtctacccaccagaaatcaacaccctcttcttccatcggatgatgtaattcttcaaaatatacttccataaatttcgggtctgtcacatcaaacaataccggttctttcttttccggatccattcccatctttgttgcaactctctcataagcatcctcataagcacggattccatctgccggatgtacatttaatgtaattttcatgtgatgctcatgcagccatcccataaattccttcggatttgggaaaaatttcttattccaggtatagcctgtccagccacttccataaatcgggtctacatcatctaccagatgccagtccatatccacaaccgccacggaaaatggaatttcttctctttcaaaccgctcaattaattctttatattcggtttctgtatagcgatgataacgactccaccagtttccaaatgtatatcttggaagtaatggtgtctctccacataaataatagaaatctttcagacattccagataacggtgtccatatccaaagaaataaatatctttcttgtttccgactctaggctccactgttccatctgacttcaatgccattgtcttagaatcatcaattaaggaaaatccattttttgataaaattccatgttctaatggaatggctccatctgcttcatctaacgtacgagcagttccaagcaaatctcttggggcttctccataatgccacactctttcattggattttcctccggctacacgaatcattaagcctcccggagtaaactctttcttatcataatgaatttctaaatcttttgtgtaaatatgaagttcgccatttacatcacttactttaaattctgtcggtgcaaaatcacgattcactaccatctgtgtcggacggtcttcaaattctccattttcactatattctaagcgtactaacgcagtggtcaacattgaaattcgataatgttcaccgcttactacatttgccgcacagcacattggatttccatttaatacatatttttccaatcccattttcattcgctccttattatttaaacctttttcgtttaagtttattataatgcaattttttttaagatgctttcaaaaattttacttaaaactttactattttgacttttttattctattatatattttccagtcaactactcgtcacctaaaggcagtgagtttccacttgcaacacgcaaaaaattttttatttatgaatcaaaaaagagatttatacaaacgaatgtataaatcccttttctatctctcaatctatgtatttttcttactctacaatacgtctgactgcaatgtatggtctgtaaagcgcattagatgaatatttaattccgccctgtggatatggtttgctgttggaagcatgtacaattccgccgtctccggtaaggattgctacatgtccggaatatacaatgatatctccggcacgggattcagaataggtaattcctcttcctgaaccagcctgtgcatcactggtacgtggcaggctgtatccaaagtgtgcaaatacctgctgtacaaatccagaacagtcaattccgtttgttaagctgtttccaccatagacatacggatttccgataaactggcttgcataagaaacgactgcatctccacttgcactggaagtacttcctgaagaagttgtagtctcttcttcataagtttcatctactgtagtattttcttccggtacaattgttgtttcagttgttgtattagaagcacctgtattagaggactggcttccagaagcactgcttgtattagaagagctgttgctcttacttgtgcttgcagctttctttgcagcctctgcttttgctgctgcggcagcttctgcggctttcttcttagcagcttcttcggcagcttttgcttcagcggcttttcttgcctcttctgcttttcttgcttcttcttcctgtattttcttcagttctgcattctgctgttcaattaattttctatattcagcagcctgagcttttacttcagaaatctgattttcatagtcagaagctgttgcttttttcttttccagttcgttttccagattttcctgctgctcttcctgagcctgtttcatctgttctaactcgcctttttcttcttctaactgatttccaagagatgttacctgttctacaacatttttcattttagagagttcatctctgtcaaactgatacatcttttctgtgtactctgctttacttaataagtctgtgatattgctggactctaaaagcatctgtgcccatgcaccacttccaccattctcataaagatactgaattctttttttcatggctgcgtactgttcatcacgctctgcttcagattctgcaagtttttcttttgtttcttctatagaatcttctttatctgaaatctcaccttttaagatttcaatttctgccagtgtttttaccagactctggtcaagagaattaatttctcctaataattcttctttctgttgttccagttctgcttctttgctttccgctgcagataatttactttctgtatttgctttttcagtctgaacttcctcttttctggatgcagctaccggcataacctgtgtgactgcaagagcaaaaataagactgagacaaagaaatctttttttcatatatattatgtacctcacattttctttctgagacaatattaccttgaacatgatatcacaaaattattacattagcaagcataactttaaatttttgtaacaaataagaggtcctgtacaattttgtacaagaccccttttgtcttttgttcgctttttaattctcttaaagtaagattactctacaattcttctgattgctatgtatggacgatacagtgcgttagatgaatacttaattccaccctgtggatatggtgcactgttagaagcatgtacaattccaccgtctcctgtaagaattgctacatgtccggaatatacaatgatatctccggcacgggattcggaataagaaattcctcttcctgctcccgcctgagcatcgctgacacgtggtaaactgtatccaaagtgtgcaaatacctgctgtacaaatccagaacagtcaattccgtttgttaagctgtttccaccatagacatacggatttccaataaactggcttgcataagcaacaactgcttctccagttgcactggaagtactgcttgagctattatctgttgtactggagctgtcatcggatacatcttcagaataattgctgtcattatcggatgtatcgttagatgcatcatttgttgtgtcattagatgcatcatcatttgaagtatcttcagaaacattgctgttatctgttgtatcttcggaagcactgttactgctattgtctgttgtatcttcggaagcactgttactgctgttgtctgttgtatcttcggaaacattattgtcactgttatctgttgtatcttcggattttgtacttgtctgttctgcttttgtgctttcagctgctgctttttcttccgcagcttttgcttcggctgctgcctgttcttttgctgctttctctttcgctgctttttctgctgccgctttttctgcagcctttcttgcttcttctgctgctcttgcttcttcttcctgaatcttcttcagttctgcattctgctgttcaatcaggtttttgtattcctgagcctgagcctgtacatttgcaatctgagtttcgtaatcggaagcttctgctttcttctgatccatctgcgtctgcagagaactctgctggtcttcctgagcctgcttcatatcttcaagctctgctttttcctgtgtaagctgttctccaagctgtgtaacttctgttacaacatctttcatcttctgcagctcatcgcggtcatactgatacattttttcagtatactcggctttatcaaacatatccgtaatacttccggattccagaatcatctgtgcccaggcattactgccaccgttttcatacagatactgtattcttttcttcatagatgcatactgtttatctttctcagcctgtgcatcctctaatttctgttttgtatcttcaattgcagattccttgtcagaaatttctccgtttaagatttcaatctgagccatcgtctgtaccagactctgatccagagaatcaatttctccaagtaatgcatttttttctgattctaattcatcggccttactttctgccgcagataatttactttctgttgctgctttctcagcctgtacctcatcttttcttgctgctgcaactggaaaagtaagagatgctgacatcgctaaaactaagctaagagctataattcgttttttcacttctttacctctctcctttttttgtgcttcactgttgtccataatagcacacttcttttaaagatgcaagcttttttcattttttattaattttcatgttatattttgtaacattttattaatatttaactccttttcttgtgcttatttttttagacaaccttactcttttttgttgtcttcacaacgttttttatggtattataaactcatcataaaagggggttcttgcgtgaacataaaaaagaaattaaatgaaatcatctacacaatctcacgctacacggaaatatttctatctctcattattctgaccgtgattgttctactgattattcccgtcgtatatgattttgtacaacatcctctgcttgaaatcacggctcacgatttcaccacatttctggggaatgtcctcaccttactcatcggtgtagagtttgtaaaaatgcttgcaaaacacaccgccgaaacacttctcgaagtgctgatgtttgctcttgcacgacagatggtcgtcgttcacgaaacaatgatcgatacgcttatcggaatcgttgcgcttggagcaatttttgcaattcgtaagtatttattattgaaaactccggacaagcagaaaatttatgacaaactttaaaaagaatctcgcttgcgagattctccgcctgcggcggatcgcttttgcgacagatttcctcaccgccgcagtgcgctccctgcggagtgtttttatttcataggatgcaatttcctatgaaacaaaaagccaccctgccttagggtggttttttattcataagctctcattcccggaaacaaaatgccatctccgtcaggatgagattttgcccgcatctgtctttctgtcagcatataatactgatatcttcttccattttctctttctcgcaaatcccaggtaacgtcgcagaaaaagtgctggtctcctaatttgactacattccacgcatgagttttagaagcatagccaaaacattcgatctggagctgtcttagcaagtaaagaaatgttactgagattccttcgcagacaccgacacgattcaataatgtttctagcgtgtaagaagcataaggataagaattatcattctgatatttcttgtttgtatacgtcaaatttaaagtaagaaaatcatagacggcacgaaccatctctgcttccgtcattccttttgtaataatctgctccaaaatatcttttgccattgccgacatctgattcatttttcttcgaatcaaatctctgtcgttataatgataactcatttcaaaggaaaaaactgttccgtcttcattttgctgaacccgttttatttcatactgattccaatagaaaaattccggaaaatctaatgcaattgctaaaaagacggccgaccagtctctttttgtcataacggtgcatgggataacctctttttctaatctggaaatcgattttacgaactgccagtaaaactcctgctgtcttcctgttaactgattaacacagcgcaatgaagtgctgtgttccatcttatcaatttttacaatttcctctgtcattttttgctcctttcatcccctgtttttttaatataccaaatatgtactctcaaagtctttcctgcatttctttactccaaattcattttttcactccaagtttagcttaaatccaacatgacatctactttctgattcattcctttttctaatgcttttacctgaattttgtctgctgtttccataatcagttccacttcaatagtcgtgtattttgcaagtggttttttacttcttaagagacaggttccaacttcctgtgccccttccaatttcatttttgtactgatactgccacttgaatacagatgcagtgcaacttttgtctgtttctcataagcagtttttacgtttgttttaatatgtaccggaagctccatatttttgaaaatcaagttttcgacgtgataactttttgttcctgcaccagaaccatctaaaattctaagaccaagtgtctcattcgacacctgcttcattttcgggattttggaatgactacctgactgattttctgaataaatcaagcctttcataatccctttttccaacatgtaagcatagactgcatccccaagtgctacggcttcttttgatttgtaagagatacaattgtttccatacatctttttaaattcattcacaaagtatggatttacattacttccccctactaaaagagtcaggtctgcactcactcctttttctttttccacctttgccagacgttccaagacaggcattaattttacctgcatcaatttttcacaaagcttatggtaatctgcttttgagattccgatttcaacctgtttattatattttggagtgtaaagaataatactatcgtactcttttcctggggcagacatacggattttacattcttcacaacggtttcttaacacctgaaatgcctctttatccccagagagatcgattccattcgcttttaactgtgctgtaaaatacgccatcatcagataatcgatatcgtctcctcctgcttttactccgtccactgccagcactttaatctgacgttttgaggcagataacaaagccacatcaaatgtacctgcacccaaatcaatgattcttaaattgagcgatttctcagataacttgtctggatacagatatgcaagtgcacaagcctccggttctgtgatcataccagccaccttcattcctgcactctgcgctgctctgcgcacaaattccttttgttttagattaaaagaagccggataagaaacaacacatttatctgtacgataattcagttttccatcaggatccattctggtctttgtatttcttttcaagtactgaaataatactttatgagcgtccaaaatcgagaaacgtaccccttcacggctgattgcaaatccattattttccgtgccaatcaatgatttcatagataaaacaaccggctcaagcatggctctttccttggcactgcgtcccacatctgaaaattctaatggttctcttaagagaacagcagaaggggtgctgttcactccctcttcattttcaattactaaaggtttttcaattttcgtgttatagactcctactacgctgttattcgtaccaaagtcaattcctatcgttttcgctgcgtattcttcaaacatcgtcagtctcctcctgtatatttatatcctgccaccatttcttttaacaaaatctttccatgatattcataaccatttctaattgattttgcaattctggcatgtttctcttcttcctctgtctccacaatatcaattacttcatgaatttttgaatcaaaagcagaattttcctttgttgtatgaattttaacccccatctcttcgaaaatagagtcaagccgtttaaaaatcagatgactctgttcttcctgttcatttgcggtcagataagaggctacatcttctctccataaagcaagctctcttaaaaacttttcgaaatcttccccttctctctgcttcgcatttaaaagtccgataaattcctgcaatatttcactctgactttcgattttacgattctgtgagtctattttttcattcattttctttaacagattttccatctggcgatactggattcttttattcatcttcatcctcctctgtgttgtcaaacttagtcaagtggatattcgcaatccgcttcgctacttgctcataaccaaatagctgctacgcagcttatcagaaggggcttgccccctcctgatacaagcaagtccccacccctgcttattgcttttcgcaattgaagcaggggacttacttgatttggttaaaatgttccatatattcatcctggtttgcttttactaatttgtctcttttagacttctttaaagggattttcattgtattcaaatactcatccatcacaactttttcgtaatatttcatttttctctgttcttcttccattttgctcgataagaacttcattacttttgccatatcataaggtgccggcaataaaccatcttctttccacatcaaactataatactcatcttgatgatactcgtaagcaaataataataactttgcaaagcactgtgttttaccatcttctggctttccaatcaaagaaaccgcaatggaatatccaaacaatctttctcttaactcattctgaaactcaaaccattcatcctctttgtcctgataataattgcgaattttagagaataaaaaacttggatttgcgctgttttcaagatactcccagcattcttctgcaaattcttctggttttttatcctgtttcttatctgattctctggttttaatttctgttttctcctgaccagataatttatattcaaaagtttttgcttgtaaagaagtctgaatcattcctttttctcttaagagattccaaattttcggaaaataaattttcagcatattttcagcagctgtacattttttctcagggtttctataaatttcccatagattttcatacagcgtaaacaaaattttttctgtcactcctaacacatcttctccagcttcttttataatctgataagtaaactcataaattttctttcgctctttccaatccaatcctaaaactgtttttacggttcctggaatccacatagattcccatttcttttctccgtttttatattccgtttttcctccaattaaaatttgtgctttcgactgaaggcatgttccattactgatagtataaagatgttcctgaagctcataaggcagaatctgatagtactcaagctgtacttttcttcgttccggctctgatccttcaaatttaaaatagaaggattcttccggatgttttaccagataaaatgccattttaaaaagttctaatcgagtttctgtatttatcttttcaagtaaatcctcttccttccactgttcaaaccattttacatctctctcaaagttttcgtttggaagtctttttaaattttctttaaattctttctcataaaagaccattccgtttactgccggcagacgaaaaattatgttcttaaattcctcaatattcattaaaaagccgtgcattgtcacatgtgctcttccatcaaaataatttccattgactttctttccctgcataaccaccatatttttatttccaattggatagattaacaatgctttttctggactgtccacttcaatttcaagacattctttttcaattttttccagatattcgattggaaatccaggactgtagcgtaaaacaccaagtccatttccactttttgtatttctgcctccaataaagtaatacatacctttccctcccgatccctattctaccgttttcctaaacttcttctttaaaatttcctttatactgtcaaaatcaaataatccatctacatctgtttcatctgattcttcgtcttcttcataatctctttttgtctcttttttggtttcttttttagattcttcctttttttctgttgctgttggataaagacctgaatcattcaacaaatacataattggttcttcgataaactgaggattgtactcatacttccattccattccatctgattcactgattcgaaccggttcactgccaatggatgctaataaaccataaaccagtttgtcttctccgatataacggcggattgtattataaaagtccgggcagtcctgactcaaatactccttgattgccatctgcttcttattgaactcttttaagttgaaaccattcttgtgaaccagttttgtatatcttttgccatcccaggaaagtgtcttctgacaaatgcctgccagtttttcattctgttctaaaagcaaatctgctctggtaattgcaacaaaaattttataatcctgacccgtctttttaattttcacttttggaagaagctggtctaaaatttcatggtactttgcaacttcttttccgagcaattcatttgaatcaatcataaaaataatgtaagaagcatttaaaatagaagaattccaatccatgttgatacattcttctccggagatgtcatcgtattttaataaaatattacgttttggagcagaaatcatataataattcgccggataaataccgtttacctttgttccttccggcagtacctgctcataaataaaggctctgcgctcttcatcctgttttctttttagtaaatcgattgccggaaaatcatcatagattgctgtatcggttcccgatgcgatcaaatcaaaatacggcaggtctgtcatctggagacgcaggcaggtttttcctgaggacatacgaccaactgcaacgacctgttgcaccggcacacagcctgcatgaatcggaagaattttatcggtgccggcttttacttttatcggtgcaaatttctgtctgccatcttttaatttcttttttaatgcaattggaaattccgcatctaaatcttcatatactgcttcaattccgttttttccaaccatatctatgcttaaatatttattttcaatcacctggctttcctctaattcccagtcttcggaaagagtttctactccatttcttaattcttcattggtaaacaaaatttcggttttctttaactccacaccatccacttcaaatggaatataatctacctcatcactaatttttaatttttcaaacataaccgttcctcctctttcatgtactctcgaaacctattcttccgtaactaatcgattgatgatctctttcgcaattagtccggcattgacactgcttcccccattaatatgatttaaacataccgtaatcgaatatggtttattttcattcaaaatgcctcctgttacaagtaacgtctgtgtctttccgtctccttcttcaccggtaccggttttaaatgccgtctcaactccatcaactgcaaagtcacgtcctgttccttctctcatgactttcaccatcatgtttttgattctgtctgccacctcttctgtacacatctgtcttgtgactgcctgtgtctttgctttcattggttcttctcgtttgtcattcgagcctaaaataaaatgaggctctgccaggacacctttatttaagattgcatttgtatacatgtttaatccaatcgtggttacggatgcctgtccctgaccgatacatccgtagaccaggtcgtaagcattttcactttcccccataaaggtattatcattaaatttgaatgaaccaaaatgcatcacatcgtcaaatccgaatttttttaagttttttcttaaaatttcttccggaacctgctgcgctaaggcaataaaataaccattacagctctgcgccattgccaactccattgttgtcaatgttccatgtacatttccacctgagcagtgaacagaaaccgtttcttttccctctgcgtctaatgtaaaggtattgttgcctttgcaggtataactgaaatttgcaagttttgcatcgtattctaatgccgatgctgcaattgccagtttcatggtacttgccggatgaaattttcttgaaaatacggtttctgaagaatctcctcccagacataccgcagcctcaacctctccggtttgaaaattactcaccataacagagctgtccatatagccattttcaatcaacagatcttcaataaaattttgtaagtctgcgtcaatcgtaagctttacatttccaccaattcgtctctgatttggatgaaacaaagatttttcatccattcttgaatcggattcacccaaaagttccggtgccatcccaagaatggtcatgcggacatttccggtttccactgcctttatataatctgttcctccaattaaacgctccagagaattactctttttatcactcatccagctaagttttcctggttcactgccaaacatcaatacattatcctttttgtcataaatagtacctggcagatacacttctgaaagactcagtaaagaactgtctaattcctgttctgacattgtcgtttttgcatctgcttccagataacggtttcccaaaacaacagccagaacaagcatcattacaagtgccactttaaacaaacgccatacctgattaatgtaactttgaagtttttctttttttctgaacatttcttttttctcctttttccataaagccaagctccacagctatgtaacttacaaacattgcatttaaacataaccctcttgatgccagaggaaggctcactcctgcactgataaatcctcctgtattagacccaatatgaagcaaaagaatcgtaccggttacaataatgcttcctaacgtccaaaattcttccattgtatctaaagttcggatggttgtcatccatcttacaagcaaaactcctgctgcaatgaccagtattcccattaaaattccgtaatcataaaggattcgtgtcaatgcatgatccgtatcacaagtcgttttaaaaataattgataagtttccaggtcccaatccaaaccagccactacgctgaatatttttcaaaaaataaacaatactttctgtctttccaaccagtgcttcgtcggttactgctttcggtaaatcaagccatacttccagtcgcactctgatatgagaaacaaacctgcaggccaaaaatgctgttccaagacagagcccgatgtaagccatccggatttttaaatccggaatcgaataccagaaaaacgctgttccaagcagagcaattagaattaataaattaaattcgttgcacattgctatgagaggaaagagagctacggtataacctaagaaaccaacatttttggaagaaagactcccaacctttcctccaagatatcctctgctgtgccctttcaaaaaccagcagatagcagtttgataaagcagaacaaccagcggtaaaatcaaaattccaaagaccttaatgtgtgctccgtttatcggattacaaaacagcgcgccgattaatgccaaaggtgcagaaagcatagccagaaagcccagattctttgactgataccagttagtataacaagtaagaacataaaaacctgtaaaaaccaaaatcaaatactttaaatcgtttgcaaaaactctgcagtttgatgcacaataggaaacggctgccccgatattcattaaaaacaacatgatgtaaattccctgtcgtttctttcgattcttttcccatataatactgattacgagttctactgctaacagtattgtaactacccatacataagccaggctctcatctaatgatttcttattgctgaatacagtccagaaaagcaatgaaaaagaactgataaaataaactaatttttcaagcattaatcttcctcccttctgaaatcgattttaattccatccataaaaagtgttgtatttcgtgtgatatgtttctgtatggaagcattctcttttaaaacagtcccctccatttcgacttccccctttaaaacagtcaataaaattttgttttttgattctatattcaaataaagttttactttactcttacatccgtaaattctgatatcgttaaaccaccctgttccaagtcgataaataccaggctgaagtgaaagttcagataccatatctttattttttaaaaagcgtttcattcttccgattcgcttaattctcagactccatattcctggaactttataaactgttttctgcattgtcgcactttcataacaaatgaaaatcaaaaaacagatgaccgttatcatttctaatgtgatgtttgtgattctcacttcgtttgcctccttccttttataaaaatctcgcttgcaagattctctgcctgcggcgggtcgcttttgcgacagctttcctcaccgcccggtacaatcctcgcaaagcgtttttaaattcataggatgaagttccctatgaatttaaaaagagcatttctgtataatttaactatacaaaaatgctcttgaatttcgtttctaattttatttttttattgctttttattctttccagaagcaatcataaaagatttttacttctcccttccagttttccgacatgtttctctcttcattgatatgataatgtcctgcgtaccaggcttttatggaagaaccaaatcgttcaaggatttcatccattttttcttctgtccgtgatgtctgttttcgttctgtaaatacttttgcacaacttttcggaagcacatgagaaagtacaattaagtttaataagtctaaatctttttgattcttctcttctaacctgacaataattttctgccattctatctttgaaagttcttcatccggccaccagccttcgttatttaacattctcgaaaaataatccgaggaatatccaccaccgagtaccagatactgactgccttcgattttaaataattctccatcttttaaaaaaatcagattaggatattcagattccacatagacttgtccaccccatcgcatctgcttttcataagaataaatgttttccggtctgcactcatgatttcctcgaatcaataaaatattacattctttttgattcttttgccaaaattcatccactgctttttgaagctcttgcttcttttttctgtccccttctcctaaatcatagttgattcctgcatctccatgcacaaacagataacagttttcttttccttgatttttttgaataaattcaatgatacgactcatgttcccgtgtaaatctccggtatgtactctcatcttcaaatgcctccttctattctctatatatcaaattttataaagaaggttctgaattttgagttaattctcacattttacctgattcaacaatcgttcatcaatttctattgttttattctttaatttttcttttaatgcatctaaaatcacttgcggatgcgcgcctttttgctgtaatgtttttaagatttccaaatcttttcttacttcatctgcagtccggtattcttcttttccattttttttcatcatttcaagcagcttttcagccacgctttcactgcatccggttcgttcctgaatcttttctatgttaacacttccatctcctttataaacctctccatatagaagccggaacataacctgaatacagctgtaaaggtctgtagctggcgtaattgcttttactgcttcaagaagcaatccggcacgtcttgctgttcgctcttctatatatctcgcttttgcaacactaagctgaaaaattttcggagctcgatatccctcactgctgcatccaattccttcgttaaatacaatcttatctgccatctccttcttttcctgccggctcatggtctttaaatcatatccatattcgtcataagaaaatacactcccgaaatcaagcaggcaaaatgattttgccacgccctctccacgaatccagatattctgccctttaatatccccgtgacagtatttatctcccaaaagctgttctacaatcactaaaagccgttcgattgattcaatcgcttcttcgatgctaagccgtcctttttctctgacataagcttctaatgtctgcccttctgaagtatccagaatcatataactgctgtccccgtaatgcgttaaaaattccgtatgaaatgcataaggactgttattttttccatcaaaatacatctcatttgccaaacgaatttctcgtctgacattttgttcctgacgtttcttttcttcttcacgatcctctgagcgaatgcaaatcggctctcctgctttttcccgataataacgtttcacaggtgactgactttcatctggaaaatattcttttatgatacacatctgtttttctccattgaaatgccggattcctttataagcaatcgctgtgcctcccctgcccactacctgaatcaagtctactttcaacactccgcttttttcatccgccagtgtaattttttgtttttcatcaatcagactctgtctctccattcttttactcccattttttattcctattttttcctcttacttagcatttagcaaataaaatatcatgaaaaactgcatagccctcttccagacagctatcttcaaaatcccatgaagccattcttaaccgattaactctttcttttaaagaacacatttcttccatactttcaaagacttctataaaatattcatcaaacggtgtgtccaaaagttccgttccaaatctgcaattaaataataaattttcatttatgtatggaagctgaatatttgctactccaagcgctttaattccaagtactacaagcagtaaaaattctcttgaaacctctctttctccagtcagaatttccttaaaaatcacttccattctacggagttcataaggtttttcttctgcatccattccatgtctgaccgctcttgcttcaaatggtgcaaatgcctctcctttttccaaatcttccttaatttcatcttcttctaagccatctattacataatcattaaataccaaacctccgtcaaacaactcattgaatacgtgaatgactttcgtataatttaatctccggctcatcagatattctttccatttttctgatgaaacctctttatactcgtcaatgtattctgctattttcgataacggacgccccatttcattcgtttttccaagcccaatatccgtcaaccagcactctttgagttccttctttaactgctctttcatcgaagcatccgtctgccaaatttgaatatctctacaaaatttttcaatctgccctattacaacaagggataataaacggtataaataccactgtctccgttttccggtatcacatacatgcaaaatcacttcctgattaaacacttcttccagcttcgtttttccaagtctggtcggatccgcaataattccattcatattttctgtaatgatatccagcgaattttttgtttccattccggtttcatccagtccagctttgattctctcacaaacttctttgaaattttttgttgtcagattatccatttcaaaattcaatgcatacgctgtttctttccgttccttccaatctttcgataagcctgcccaaatatcaaatccctgatgtgtttttaagacataatacaaaattagttctgtcatatcacttttattatccatacgcattaacgcatacttgcaccccgctgattcacagatatcttcataaagttccagataggattcttctttatcaatatttagctcattttcaatcacaacaaacatcagagtcatacactctaactcggagagctttctctcttctacttgctctcccgattcttctgcttttaaatcctttataaactgtgtaataaatttctgacgcaattttttatgtccatttaaatattcaaattccaattctccaatctgctttatcatttcttttgacgtttttactgtctctttggcttcccatttttctattgaatacggataatctgttatttcagcaacgcacttcaacacttctctatacatctttatcttctcctgtcttttttattctaaaaccttctctcagaaaattgtttataaatactcctctatcttagttcgatattctttcactaattcttgcagttctgtccacgcttctaattcctctaattttttctgcaaatctttcaaaacaccaacattcattcttctgtttgacacagctaattcaactacacgctcgatctgtactggcagttcttctaagatttgtttttccagattttcttctttcttttcttttaacagacaaagttcacagccaattgcccgcactaaaaataacgcatccggctgtgtcttttttactgcttcccgataagtttcatatcctttttcatattgtttcatgcaaaaataatcactcataatcgtccggtaactgtccatcactctgtcaggaagagaaatcttacgaaactccaacgcttttttatgccattttaaagcttcttcatactcttttctctgataataatagcttcccatattcgaaataatttttccgtaagtcaacttatattcttcctgctttttttgatattgcggcacattttccagttcttttattgcggcttctaatagcggatacgcatccctcttcttctctttattacaacaataatataaaaaattataacaagtcccttgttctaatggcgttaactttattttttgcatttcctctactgcaatccagccaatttccacacacttctgattctcacttaagtcttcatgaagtcctgcaagctcataataaaattcaaaggcttctttttttacttcgtcctcttctgctaaaaagcaatacaattctgctccaagctctccataaatgaattccgcaaaatcaaggtgacggcatcttctgctaaattgggctgctttatcaaacttaggataatattttaaattttttattaccaaatctataacttcttttctattctttgtctccagaaatgcacacaaagccagatattctctaattgtttcatgcgaaaattcaagctgctcatctacgattcccagctttggaaggatttgataaatcaatgccttcgtcatattctgcggaattattgtctcactcaaaacttgttccaataagctttgatattccaaagttctgagcttgttttcttccgaatccacatttatccaaagcaacgctttctctacttccaatgctatcttcggtaaaatctcatgaattaaaaagcgtcggatctcacgaatattatcacgatgcgcttccattgaatctgctaaaacatctagctcaaaatatttttgaagcaactcatttctactttttaaccgcatcgcttcttccggtgcacgctcataaatctctcgaaaaagttttaaaaacattgggttttctaactcttcttttaaatggatttccggtgccacccattgtgtaggactcagctttaaatacgcatcaatttgtgttttctccagcttttcaaattcaatctttttaaatttttcttgaatcgaagggtcataaaacgaaaattctcttctgcttgtcataatgatatttacatttgaaaaagaactaagctcccgaatttcattttccaggcactcgtataccatcattccattttccagacaataatctactaattcattcactccatctaataaaaacaagaacaaatactcagatgattctcttaacatcttgcataccacatctgtccgtaccgcctccttaaaaaacgcacataattcatccagcaaaaagtttcctcgaatccgttttcgattccagacattcatcttgaaatacaacggaattactgttttattgttgagcattgcccctgtcagttctcgctctaataataaaagcgatgttgtttttccggttcctccagatccacataaaatataattttcaggataagtttgataaaattccaataaattcaaatggttcaccagctttcgtaaataagtatatctagacttattatagcaaaaaaagccagcactcaaaagcaactctgggattaattctggaaagaaccttttcctgccttgaaattttattcttgctggcattaattacgataaagaaacaaaacatcacagttgttccattaaaaaaattgatcattctaatttttagcatattaaaagagatggtttttcaaccatctctttttcctctgaactcacttttctcgttttaatttttttctcataactccgccaactaatacacctgctcctgaagttttttcgtggttggttttttcgtcaacaaccgagaattcccgccctaattcttaaaccttcttcatgcaaaaaaactccccgccatctggcgaggagttttccacatcttattttacattctattcaattacaattacagtttcagattaactccgatttcattcatatttttcagaattgcatctaccgcagcctgcacttcttcgcttgtcagtgttcttgtatcaagaccaaaggacaaacgaatggttacactcttcactcctgctgcatcatagatatcaataaccgaaacttctcttaagatttcaagttctaatttcttccagcactcagaaatcgtatcaaagcgtaccccttctggaatcagtaaggataaatcatattcaatcgtcggatatttggatggttcattgaactctaagtccatagccggaattgcaagtaatacatccatatcaatttcaatgcataccactgccgcatttttcgcaatatgagccaaagtctttggatgcagtgtattcaaaataccgatttcttttccgtctaccaaaatctttgttgtattcttcggatgctgccattcatgtcttacttctgttttttcataagccacttttttatgtttcagctgacttacaatggtatttaaaagctgcactgctttaatatataatttcttttcgctttcttctttactgtacatcgcgattccgagcatgcgatgttcatcggcagtctcatcttctcttactcctaatacggtacgcgcaatttcaaacattccaaagcttggtttgtaattacggttattgtataccaatggcaggaagctctgcatcatgctggttcttaagattccattgtcgtctgcatgacctaaaagacgtacattttcttccggagcaagtccaagatttctaagagcatccggatcacaccataatctggtattgacttcattcattgcataagcttttaccagtaagtctttaatcagattttcttcttttctgcgttctgttgtctttgcaggaagcagcggagataaggttgtcttgatttcaaagttatcatatccatagatacgtgtaatttcttcaataatgtcggctctcatgctgacatcttttgttcctctccagcttggcacttctgatacgaagttttcgccgtcctgtgtggtcttaaatccaagctgttccagtgttaatttaattctttcacatggaatatcaattccggtataacgatctacgaattttttgtcaaactctacttttaattccggatattttttcacatacacatctgtaatcttacttgcacattcacattccgggtctacgtcttttaaaagcttgatgaaacgttttacggcaagcattgtcatttccggatcaagtgtcttttcataacgtgcagatgcatcggtacgaagtgctaatctggaagccgatttacgaacacttaccccgtcaaagtttgcggattccaatacaacagaggttgttccgtctacgatttcactgtctaaaccacccatgattccggcaactgcaaccggtgtttcattatcataaatcatcaaggtatccggtgtaatttcacgttctacatcatccaatgttttgaactggaaggattcttttggcgtgtcaactacaatcttttcgattttatttccgtcaaatgcatgcattggctgaccaagttctaacataatgtagttagttaagtctgcaagcagattgattgctcttgtaccacagtagaacagacgaatctgcatttccattgaactgacttttttggttacattttcaatgcgcatgcttgtgtaacggaataccaggtctttgtttgctacttctactgcaacagttgcatcacctgtgtatggattttccattacatcaagtggttttacatgctggttggtcagtgctgcaaactcacgagccattccataatgtccccataagtccggtctgtttgttaaagatttattatcgacttcaaataccacgtcgtcgattgggaaaatttcttttaaatctgtaccgttctttaagtctgcatctaattccatgattccgtcatgtgtctcagaaattcccagttcttttgcagaacaacacataccgaaagatttatatccacgaattttggaagctttgattttgattccgcaaacttctccgcctactttacaaaatgcggtttttaaacctgctcttgcattcggggctccacatactacatcgtaaacttcatctccggcatccacttttaataaatgcagatgatcggaatccggatggtcttcgcaggaaagaatttcaccaacaacaacatcttttacatcttttcctttatattcaattccttctacttctgctgtagaaagtgtaaatctgtgaatcagctggtctaaatcccatccgtccaaatttacaaagtctttaatccaattcattgatacgaacatgtttcttcacctcctatttacttacgaactgtgacaatgcatttaagtcaccttcgttaaatacacgaatatcttttacgccatatttcatcattgccagacgggtcagacccagaccaaacgcaaatccggtatatttatctggttcttcttcggtgttaattcctgcgtattttaatacgtttggatgaatcataccacatggacacagttccagccatccggagtttttacaggatgggcatccgtcaccgccacagattaagcactggatatctaattcaaatccaggttccacaaatgggaaaaatccaggacgcagacgtacttttacatctctttcaaagatttcagaaagcatggttttcataaaataaatcaggtttgaaatagagatgtctttatcaatcataattccttccatctggaagaaagtgttttcatggcaggcatcgattgcttcatttctgaaacatcttcctgggaatacggcacgaatcggacgtccttcttcttttaatgcttttgcatacttcttcataattgcattctgtgcagcggaagtatggctctttaataactggtttggtgtagacagataataggtatcctgcatatcacgtgccggatgatatttcggaatattcagtgcttcaaagcaatgataatcatctacgatttcactataatcttctacattaaatcccatagattcaaagatatcctctaattctctctgaatcagagtaattggatgataagaaccacacggattttctgtcggaagagattcatcgtaggactctgcctgattgatggctctttcttcttccagacgaatcagttctttttctttttcttcaaattttgcaattacttcctgtttaaatgtattgattaactgtcctgttgtctttttctgttccggcggaacttttccaagctctttcattaagcctgaaacatacccttttttacttaaaaaatttcggcgaagttcttctaaagaagaagatgcatttacggttccaagttcatcttgaaactgttctctcagtttttgaatcttgtctttcataatttcctccataaattaaaaattcaagcacgcttctcatttattgaaataaaaaaacctcgccccacaaaaagggacgaggtatctcgcgttaccaccctaattcaaaaccgctgtttttttattatttctattctttctcttatacggttttgctctcatctggctttaatgcagccttacatctgacttaacgctgaacttttacagcttttcgccagaagctcccgtgctgaaattcgatttctgatgtttttgcttctgcttacagccggtgacaaaagctctctggaaaaacaagttcaaaaatctacttacacacattcttcgctttaaaaattctaacatacttttttttaaaaatcaataagaaacagccgaattattttttaataagccagctgtttctcttatctttttattcttttactccacctaaagttaatccggttacaaaatatttctgtaagaatggataaatacaaataattggaagcattgtgataatcgtagccgctgcacgaaccgaagtaggtgtaaccgctccaattgcatttttcatcgcttctgccgaaccaccctgatttgttacagacgacaacagtttcatcaattcgtattgaagtgttgtcagactactattcatacggttatacagcattgcatcaaaccaggaattccactgtccaactgctacaaacagtgcaacggttgcatacactggtttgcataacggagaatagatttttaagaaaatcgtggtatatcctgcaccgtctaactgcgcagattcttccagactattcgggattccgttcatatatgtacgaattaccaacatattaaatgcacttaccattccaggaattacatataccgcaaaactattggtaagtccaagtcctttatataacaggaaagtcggaatcattccaccatttacatacattgtaatgacccagaataaagaaagtcctcttttaaacaaaaaacgttttctactaataataaatgcaagaattgcattcgataccaaagccagtactgttccaataatcgttcttgatacggtaatataagcacctgtaagcagattatctttttgtaatacggtaatatagtttttccatgtaaattttcttggccaaaggtaaattcctccacgaagtgcatctgtaccatcatttaatgaaattgccaatgtatttaataccggatataatgtaataattacaagcaaaatcataatgattgcatttacaattggaaacacttgtattttcttttttgctttttttgtctcttccattgtcaaattcctcctgattagaataactgttcctcaccattatgttttgcaatctggtttgcaattacaatcaaaatgatactaacagcacttttaaagatacctgccgctgtaccaattgcataatcaccctgactgataccccattttaacacgtaaatatcgattgtctgagatacactctgtaccaggccatttcctaaaagatactgaatttcaaaacctgcatttaatacattacctacattcataagaagcagaataataattgtaggtttaattcccggcaatgtgacgtatttaattttttcccatcttcctgcaccatcaatggaagcggcttcatataaagacgggtcaatagatgtaatagccgccagataaataattgcattccatccagtttctttccatacatttgcaaacgctacaatcggccagaaatattttgtatgtgcgaaaaagttaatcggcttactaatcagatgaagatttacaagtaactcatttataattccggttcccgaaagcatatcatgtaaaatacctgttacaataatccaggaaaggaaatgtggaaggtaagaaattgtctgtacgactttctttccaccttttgatttgatttcgtttagtaaaacagcaaatgcaattgctgtaaaaaatgtaaccacaagattaattacacccatggccagcgtatttcgaattacgcgaataaatgtcatatctgaaaacagcatccggaatttttctaatcctacaaattcagaatgaagaattcctgttcttggcttataattctggaatgccattgcccatcctccaagtggaagatagtaaaagataattccatagattaccattactgctgcccaaaacaatagtactttctgacgttttatttctttccatgtgattttatttttattttcttttctcgattttgtttttaccattgccataacatcactccttaaaaaacaggcagatgaaattttatgctacatctgcctgcctttaaatttcattatttaaattgtgctgcctgttccattcttctgtctaattctgtttgtaattcactaataaaatcttccggtttacaatcgctatatgctttcatatattcgctccatgcaccgtcaaaatcttttgccattacaacctgtggcagtttttcatgtttcaattctccaatttttgtccatgctacaccaccgtcggtatctgttgtaaagttattggaataactccacattggataccagtctccaggtgcatcatttgtaccaagcatctctacataagtttctgctccatacgcctcaaatgcttctttgatatcatcatttaagcctgagaaaaattcacttgcctgtccatctggtttatttgcatttattccatcttcacttgttcctgtatactgtggtaagtaagaataactgcacatatgtgatgctttatacgcagtatcggatacctgcattctttcttccggagttctgtaaaattctccgttctcatctacttcatagtctttaccctctacgccccagaaacgtaagttatgtacttcttgtgaaagtaaatcattcacaaactgtaatgcaccttctacatcctcacagcttgttgtaatcgcaagtccacttgatgcattaaatgctccaccggcattatgccactggttatcacgcccatcaattgtaacaggaaccggaatataatcacagccctgcttatccagtccggcttgtttaattgcatcatttgcatttaaaaaatcccaccactggtcaatcattccaagtacacgtcctgaagaaagttttgagatatattcgtcatagctctgagtaaatgattccgggtctacaattccttttttatactcctcatttaactttccaaaatatgcttttgcagtatctgttgtattgtaatccataactttctgagtttcagggtctaccatacaagaaccatcatttggatatccatccaagaacattggagcattttccagacagaaatatctccagtcatcgcataaaatagtatacggaatattttctgttccatcttccattgtaggatttgcttcattataagactctatcagattaaaatagtcatccattgttttaatttctggatagttagcccattttaatactcttgcctgaatccaaaatgcttcatcattatgagtacagactttttcttcacctttgatgcagctaaactgtggtatccagtaaatatgaccatcttcctgtcttaatttttcccattcaaggtctgtaaataaatttttaatattcggatagtcatccagataatcatctaatggaacaagcgcttctgcatcatataactgttgtgttccatttcctccctcaataaaatccggatactctcctcctgcaatcattgttccaattgcttctacatccgtctgtcctgtcagccaagtttcttttacttttgctccagtcttttctgcaatcagttcctgaatctcattatcatcattaatttccgaacccggaactgcaaaaaaggcagtaaactcttttactcctccttcatctgaacttgatttactttttccactgccgccgcatccagtaaataatgtggcagccaataccgtgcctatcagtacacttgcaactacttttcttctcatactgtaagtacctcctttttgatatatttattatacttgtttcactttttacaaaccagctgagaaattatagtcaaaaacaggataaattatagtttttctttatttgttctataatttatcctgctttttattattcttcaaacatttgttttctaaatcttgccggagtgcagcctttcacctgaataaatcgattcacaaaataatccaggtcatgatatcctacttcctccgcaatttgtataattttcttatctgtatggatgagctgattcgatgcttgctcaatccgataattatttaaataatctttaaaagactgtccatatttctttctaaataactgccccagatatgcactatttacataatatttttcacttagcccttttaaagtaagattagaagcaaaactctcacgaatttctttttctaccataccaagaactcctcttgaaacattctttctaagttgaaaaaggtactctgcatattcacatgcaaaacttgcaagatgcgctttacttcctcgcataattccactttcaaaactgctctcactgattaatcttaaaatttcctgttgattcacatcatcatcctgctcgcttgcaagatgaatcaagcgaaataaaagataattgatgttaagcgtcatggtctcactgttcattcccatatttcccatttcctggtaaaataactcaattgccttttttatttctatataattattttgctcgattgtcccaatcaaccggtccagactttctttacacaatacaatcttattacaggatacctgcacctcatcttcgtaaaagtaaatggatttttgcgcccgaaatccctgaaaggaccgaagcatacaggtatttccataagactttgaaatactgttgatatctgaaaccttctttccaaccaacattatcagtggctgtttcatattatttaccagatattgataaaacttttccagataagctctttcatctaatcctaatttttgcgccatcccatctgcaaaaatcagaccaatatcatatattttttcattcgcagatacatcaaacacacaatggtttgcatcttcttttaaaaattcaatgcagcactgatataattctctttgaaaatttctcatatctttttctatactttcatccatttcctcggattgtgctttttgaatttcaacataacgaactccctctatattcttcatatgttgttttacatattccaaattgaaatcatcatattttccatgaatcagtgcaattacatttctggaaaagtaagctttttcctgctcttttcgctttttatccaattctctatcctgacttcgcattgtataaactttttccagtaacttaagtaacatttcacggtcgataggctttaaaagatattccgtacactcattttgcattgccctcctcgcatactcaaaatcggcatagccgcttaaaatcacaaaataagcattggataatttttctctttttatggtttctaaaagttcaagtcctgtcatctctggcattcgaatatctgcaataattaaatctacttcttcttgttctaaaaatgcaattgcctctttcccatttgcagccatccctgcaatttcaaatccctcctgttcccagtcaatgagcatttttattccttgcagaataaatggttcatcatccactaatagtactcttaacacttaattttcctcctcatacatattcagcaggtatctgaatcataaccatggttcctaccccttcttctccttcaatcgtaaatttcactttatcatctgaaactattttcagtcttaaacaagcattaatcacccctactcttccttttactttcagcatttcaatacttgcattttgcattttattttgtaaatcctgatactcattttcgctcattccattccctgtatcttctatttcaatatataaattttcgtttttttcatagattcttacaaaaatccatcccggagaggatttactttcaattccatgtacacatgcattttctacaaatgtgaccagagtaagttttggtataattttcttctcacattttggacttatatttatatcataatttaatcgctctccaaatctatatttttgaagtgccaaatatgcttttacaaattcaatttcctgttctatttccacacagtctgctccccactctacatactgtctttgcattaatgcaagtttttctaccatatctgccgtttcattttcttgttttaaaatactatgcatccggatgctttcaagcgcattaaataaaaaatgaggatttatctgactgtgcaatgcaagtaactctgcattttttcttcctactataatctcttgttctctgattttacttttatacaccgtttcaattaaatgattcgttctctctaccatacgattatagttgcgaatcatacttccaatttcatcttttccccgttcatctgacatataaatcagttgttcattatttacggactgaaatactttacttaattttgtaatccttttggtaaaagaacgattgattaaataaacaaataaaaccggaagtattacatttacaaaaataagtaataatataatctggaatttattcataagactatcccacccggttttctcactttcatctatacggatttcaagttctgtcccgtaaagatttacctcctgacaataagtgtatttactccttttctttactttttcataattttcactttccgttccatgctttttattggaaagcacaattcttccctcatttaaaatttcaacttcattatcataattcattttctttagttcatcgcttacttttccataatccaactctacttttaatattttttctttattcggtgaatagaaatctaatttctgcaagaaaacaatctgccttttttttgatattttgtttctgctctcatcatatacgaaaaaaatccctttgctttttttctgttcgactaagctttgatacgcttttgtttctctgatattttcaatcttatttacctttcctccatttactatcgtttcattatctatgtaaaaagtaaatactaaattattcattcctaatatattttcaagtaaatggtccttgaaaaactcctgataagtcaacacatattccggagcactttcatattcttgcatcaaaaacgaattgatatatttactggtataaatactttttgctgtttcccctatgctgcttatcgtattactgatattatagcttactgcatttgcaatatttgccatctcatgttgttgtttttcctgttctgaacttctaacaatgaaaaagataacactatccgtgataataatggggattaaaacgcatatgagataaagcatgtataatttttttttaatttttaagttatccatcccttcttctatccgatgcaataattttctcattttcttctttctcctgcttttttctaaaaccacttcagggagcagaaaaattctgctccctagtcaaaaatcctatatctaatcaatccatatttttcaaataaaaccaaccaaaatccgcataattctcactttgttttccatttgaagacgcatacattcctaccgtacaccctacaaatcctcctgcctcttctgttgtatacgcagtaagaggaatcttttctgcaaccggtttaaggtttttctcttttccaatccatactctggcttcctggtcatgacattgaatcataatttttaaaattccctgccacttactaatatcaactattgaaagttttgtctcttccccatgaatataagagtttacttcaaatacttttttcccttctacctgttttatttcaaactttaaatgattttcatggttctgatacaaaatcactcctgctgtttcattttctgccttcggttcaaattcaatccctgtttccacctcaaaacgataacttttttgtcttaatcccaaataggaactgtagtctttttctgaaattttctcttttctacagtataatcgtaacattccttttctctctgaaagagaataaatttcttcatctcgtttttcgattcctactagtctttcatctaactcattttcccaaaactgaatacaatctgaagaagtcacttcatttgcaaaacgatgttcttcaagcggaatctcaacaaaatcttcaagccgtccaacttgtggggcgataaccggccatccgttttcccagataactttcgccaaaaaagtctctcttcccatgctgctatgttttttacacggtcttgatgcaagcattactacataccagtttccatatccatcatccacaaggtctccatgtcccgcatagacaaccgggtaatccattcccagatttctgtgtgtaaaaatcgggtttctaggacagccttcaaaccactgaaatagttttttacttcttgctacactaatgctatgttctggtcctgttccaccttctgcatgcattagataataatactctccaatcttataaatatgaggtccttccggccagatgactccctttacagcccctttccagattgccatactctcgccgaccagtttcatactctttaaatcaagttcctgaacccagatttcccagtctccgttgtagcgtaccccttccggattcggccttgtgccacaatagtaacacctaccatcatcgtcaaaaaacagacttgggtcaattcctattgcttcttctcctaaataatatggttctgaccatggtccttccggattctttgcagtaacaataaagttccctccatagcttacgtttgttgtaatcatgtagaaaagcccttcatgatagcgaatcgtcggagcaaaaatccctctcgaaatttcgcttttttcaacttgaagctgctctttgctttctaaaatatttccaatctgctcccagtgtgctaaatctctactatgaaaaatcggaactccaggtgcatatacaaaactagagtttacgatataaaaatcattccccactctacaaatagatgggtctggataaaatccacttaaaattggattctttgcaattaccatacttcttctcctcctatttcacatatccgaatccaagaattgtaaaacatttctctctttcttcctttggaatctctattcggacaatatgttctttcgtttctttttcattgaataaaatgaccgcattacaatgaagccagttattgatatgtgggtctgcacacaggcaatattctgtgtctacccaaacatctgcttttcccacatttgtttctcctgaatctttaaatatcaataataacgccttacagcttattttcatctcaaagtatgcattttccggcgaatctccattatacatccaattatgcggaaactctggcactgtcattaaagaatcatcgatttctacacattgcaattctttatcacaatgtacaaatcctccctcatcaatcttcgcacctacataactatcttttttatctatcaggtggactgactcgaaactatttccaatgacaggtgtttccagaagccttctctctaatgtttcctcatcaaagattcctgttacaaatttattttttcttaatccctttgtttcttcacatcgttcaaaaaaatagctaagacaatctgccataatggtatgtcccaaattgctcggatgaaacatatcatagaaaaactgattcttcgttatactttgtttttctttgtttttaaactgaggcactactgcatcttttatgctgaccattggcaaatcatatcttaatccaacaggcatcaaacgttcttgaagattccagtcatttgcaaacactgaaaacagcaaaataactgccggtttccatggaagcttcaaagctttacgtacaaggctttcataacagtctccctttgtttcatctccttcatcattcactgcaaattcaatgacaatgatatccggctgttcattttctcttaatacatctctttcaaaccgtaacattccaagctccgatggagttcctcctacacctgcttttatgaattttacattttcttttattgcaaattttttctgaaacatcttccacgatttatacgcataacactccgtatggatcggcgttgctcctgctccctgggtaatagaacctccaatgtatgctaaagtaacaggcttgcctgattttgctttttggattgctttttgtatccggaaagtattccccatacttaacaatgagctgcgaaccatttgactgtactgctctgaattaatatttacggtttcatcttctatttgttctggggcatcatatccatcgtttaaataaagttttacacttgcttttcccattatttccggagtttgaaatataaattttatctgtcccggaatattatcgtcttctgtccattgatattctgacaacaaaatcttatattccattccatcgccttttaatttcgtttttaggtttgttcctcctccatagaggtcattctttccatatatctgaaatataaattctatttcttcttccggattctctgtttctacaaaaattccgatactatggaccagttttccaaacccttctactgtctctaaaagctttaactcctctttatctgtaacattacctgctatctgtgcgctatttattaatcgtccatcactctcataaatatattgaattcctgttccatcctcctgtctggaactaaaaatttctttttctctcataatataaaaatacggtctttttttctctggatttttcggtgcttttggaccttgcatctttctttctccccagtctcattcttaatttcatttattataacagactacactctttagaacaccgggagaaattatagaaaaaactccgacaaaatattacgttttattcgaatcctaattattaataaattcgatagtttccagacaaagcaagcattgaaaacatataaaggaaattatcataatatcttctgtctcctgtgcgaagcggtgtattccagaatttctctacacattcttttgcatacggaccatttgctgccaaagatgcctgagcattcgttgcaataattgccaccggatgcaatgctttctcttctagtcttgttccatctgttaaaaatactccatcccaatgtagcttctggtcctcacagtaaaatttctgaagatgattcgcattttctacctgccaggaatctactccaaaccactcataatccagtccgatatttgcaatcgttcgataagcatcactataataccaatcatgacgtccaaaaatctcctgatgccctttatgaggagttccatcataatccgcatattccgccgataaacctgtttttgggtgacatgctttatgaagatagtcgcgacttgcctttgctgcctctttccaaaattctctatcctcgggatttgcccattttgcaaataattcataaaaatgagggagatgataagatgggtcactaaaatcacagtttggaataaatttaatcaaatggtttttcgcatcccacatagaatcacccggttgccccggttcgcctttatgtacacattcttttaagattgcccttgcctctttactatactcaaaaattccttctccgtcaccccatcttctccacgcaaagaataaagacatcgcaaaaaattcttctccatccggagccggtccatctgaattccaagttccatcagtgccacacgaccatgcaaaataattttttccaggtcctttcggaatatacatataagtacgaacccatttccaaagacggtcaaattcttcttttctattcatctgtacacacaccatcattgcataagacattccttctgttcggacatcgtgatttcctgtgtcttccacatacgccatgtcttctccgacttcatggtaaaagcgttcttcttctgttccataaaaaatagtctcaaaggtcttctctactctctcttgaatttcctctttagaatatccgcactccaaaaatacatttcgatattttcctgtctgataagctgctgtcattttttatctcctcatactatattattttctctgaattttttcaattataacaaattccatctcatctaataccgggaataattatagaaaaacctccgacaaaatattaagattctttcattgataggtccctttagtttaaaaaactctccactttttttccatctctttcttgcgaatagatatgcaaaaattgcggagtttcttttttcttttaataaaaataaccaatagacatgaaaaaatcgagatatccacaatctttcttcatgcctattggtctactattctaattcacatcttctctttataatatttttctttcaagcaaatatttttttatttcttttgtgaattcatatattatatcttgcactccaagtggcataaaatcatctcctttccgtatcagaaaccgtacgttttttatatttttattatatagtgtttgtatttccagatcaatgtccttaatccctgatacaaaaagcacaaaaaatcccccagagttactgcccaagcagtttctccagggaattttagctatccaatcaaaaatggtatcacatacgccacaagtacgattactaccgcacatgcaaccacaatgctccatattttaaattctttatccatttttttcttttcttccggacttggtatttcttcttcaatgactcctgacaaatcttcctgtacttcatttttatatttacttctgcagactgcataaattacaagtccaagtgcgcaccagataattcctgttatcattgcttctttatctaattgagtcatcataatcaaataaataataatactgattggcgctcctatcataattccaggtgctttaaacggacgtttgagttccggatgtctttttcttaaacataatgatgcagtaattccgatgacgtagtaaaacaaatctgcaaacaaactcaaagaagcaatgtaaatcatagaatttgatgcaatcaaaaatgccgaaagcagtccaagcacgataatggatacataaggagtctgatattttgggtgtacttttgcaaagatttttggcattgcgccatctcgtgacattgtaaataaatatctcggcggaactgcaatacttgcatttaaagtagaaaaatctccaccaaaggcaattccggctgccaagagtaccagcggaaatccaagaattccggccgttttcattgcttctgcaaacggtgcagacgcagttgccaatgaagaaatctctgaaatcggtacgattccgactaagaaccactgaaatgcagagtttactgcaaatacaataaatggtgccagaatcagagcgcgtggaatattaatctgcggatatttgatttcttctcccattgcacagcaggtttcaaatcctgcaaaacaccaccaaatcatactgaccgaagcaataaagctaagtggtgttgattttgcaatgaaatccggcatctgtacaaagttcggcatatttacatttggaagcatcattaagaaccagataattgccacaccccagaagaagaacataaatccattctgaagttttccggtcatttcaattcctcgcacatttgttacaataaataccagaacaatcagtgtcgctacaacggtatcactgactggaagttcaattccaagtgcagagaaaaacgttttaaaataaaaactaaatgccagtgcttctccacttgttaccgataccagtgaaataataaagttccaaccagccagcattccaaacggttttccaattccgagggaagcatattggtaggttcctccggcatacggaagtgcggctcccatctctgcatataataaagatggataaatgctgattaacattgcaactaaggttgccagtataaccgccggtcctaaatcaccaactacattggctcccgtcgtaaacagtccaactccgacaacggttccaactgtaatggtcacggcttctctcatcccaaatgttcgctttagcgtttttttcttttcctcactcatatctcaagcccctcttacttttatttttgtaaagcggacattcgcaatccgcttcgctacttgctcatgaacgcagtcgcttcgcaatctgccagtgtgagctttcaactcccactggcataagcatcccttctctcctgcctcttagtgctctgcgcacttgaagcgggggaatgcttatctgcgttcaaatagtataagttatttccgaatatctgctgccgctttgtgtcccattaacccttctccatcagccagtcttgataccagcggagccaattttttcgatgcttctgctgtcatactctgctgagtacaggtctttaagaaggttccaacccacacaccaccggtatagcgtgcggcttttaaagtcggaagggtgtgattggtaccggatgcatagtccccaaagacttctgcggtattttctccgataaacatcgaaccatagttgacaaatccttcaataacttcttctggatttttcaagtttaactctaagtgttccggtgcataatcattgactaaatccactgcctcttggatatcatccacgactacgacttctccgtaagttttccaggattttcttgcaatctctgcggtttcaagtacctgaagttctgcttctacagcttcaatgactgcttttccaaatgtttcatcggttgtaactaacattccttttgcattgacatcgtgttcggactgtgcaaggaggtcggctgctacaactgccggtgttccgctgccatctgcaatcacaagcacttcacttggtcctgcgacaaaatcaattccaacttgtccatagcactgcctttttgcttctgtcacaaaacggttacctggacctacaatcatatcaactggtgcaatctcttctgttccataagaaaatgctgcgattgcctgagcaccgccgactgcataaatttcatctacccctgcaatatccattgcaacaagtgtcttcggattgatttttcctttacctttcataactggcgaacaggctgccacacgtttgactcccgctacctttgccggaataatcaacatcaatgcggtagaatacagtggataatttccacctggtacataacaacagcaggaattaaccggaataattctgtgtccgagaaagattcccggcatcggactgaagttttccagtggttttacggtctctctctgcgctttcgcaaaggcacggatattagaagcggctgcttttaaatctgcgatttcttcttctgataactgtgcatacgcttcttcaatttcgtctttcgaaacacggatttgttctctctcgcacgcatcaaattttcttccatattcctttaatgcctcatccttgtttgctcttacattatcaatgatatcctgtaccagacgggataattctcttctgtcttcttctgttctttcctgtgatttctttaaaactctcataactaaaaacctctctatcttttatgataaattacttttcttattctctatgctactatattaaagcgtctagtttactttaggtcaatatagaattttctcattttttcttcaaaacatggagtatactccatattttcattgatttttttactccaaactactacactacaaatacaaataatttttatgtgaggaatttttatgcgaattggaaaagtttcaaaagaatatcatatctccatcgataatctgcattactatattaagtatggacttcttgttcccccaaagccaaagggacagtatttctttgatgagaccacgttaaaagacttagaatggattcttgctctaaaaaaattagatttctctcttcgggaaattcattcgattttgtctctgaaacgaatctcaaattttgcagatgctgaagatttagaagaactaaaagaattattcaaaagtaaacgggacttctgccagcaagaaatccagaaaaaagaagcggttataaaaaatttagatgctcatatcttacgcatggagcaggcaaaaagaaaagaaaaaagtccaactggtgttcctgttaaagccctttccattttatgttgtccaaaatgtggtgcttctttttccatgcaggatgtggaaatggaccagcgttttttatataaaggagcactgtcctgtaaatgcggttattatgccaaaatttcttctggaattttaatgacaccaaacaaaaatcaaaatctgcaggacacacctgatttgactcgcgagctttataaagatttgccacccgatttaatcagcatgttcgagcgttcttataattggatgttagaaaaaatgaaccaagtcaatcttcatggaaaaatcattgcagaaacttatatcaatgcctggttttttatgcacaatcacttgcaggcgcttccaacagacagcctttacattgtcattgataaatatccggaaacccttttaatgtataaacatttaattgaaaaacaaaagccggaactcgacattttatatattgccgattctagcacgaactttccgttaaaaaaacactgcattgatttacatctggatttctttgctgcaaatgaacataacttttatcatgatacctttttatataaaagaatcattccatttttaaaagaaaatgctgacctgattggaacttatttttatttttctcatgcacaaaaatccatgcgaaccctgctttcccagtatcctgaatgtagtgcaaataatttttctctttcttattttaaaaactcacttgcagaatctggctttatcttaaaagactgtgaacctttagatgctgtaactgattctggaaacaatcttggatttggttttcatcaaaaaggagaaaaaatgtatctgatgccttattatgctcaaaaaaccggccagtagtttctgaccggtttttctttccatccatatttttttcattcttaagcgaaaaacttccctgctgcctgaatcagataccaggtatctttaattccggcagtctcatacggagagtgcattgcaagctgtggaagtccgatatcaactgcatttaacgcaacttttgttgttgagatatttccaagagtagatcctcctaagatatctgaacgattcgtaaatacctgatatggtacatctgcttttttgcagatatctttaaacattgctgctgaaaccgcatccgtacaatatttctggtttgcagaatatttaattacaattccttcattcagatatggacggtttaccggatccgccacatcactgtaatttggatgaacggcatgtgcattatctgcggataacataaagctctttgcaagatttctgacataatcttcataagaatattccatacattcattgattcttaccagtacatcatacaggaaagtagacgctgctccctgttttgttccactgccgacttcttcattgtctaatacacagtgtacggccagatgtgcttttttctcaccttttaagaatcctttcaaagaagcaaacgcacactgtaagtcatccagtctggaagaagaaacaaactcttcctttgctccccagattgttccttttacacgattgtataggaataaatcatgtgctaagatatcatcttcctttactcctgctgtttctgcaattgttttcataaatgtatctttagaatcaatatctccgtaaagcggaagcatatctttctgtgcattgtatttataaccgtcatttacttcacgattcatatggattgccagatttggaagcatcaataaatcccggtctacatttaccagttttgtgacaaattcatcgttttcgtttacaataattcttccggctaccgaaagtggacgatcgaaccatggagaacaaatcattccaccataacgttctacatttaattttacatattttttatctacctgcatttccggattttctttaattttaaaagttggagaatcgctatgacttgccatgattcggtaacctgaaaattcgtcttccggcattacaaatgcaatgatagaagaatcatttcttgtcacataatactttccacctttttttaattcccatttatctgcttctttgatttcttcaaatccttccatatcaagcatatctttcatggtttttacagcatgaaagcaactcgggcttttttcaataaattcaagtaattcttttgctgtttctttatacattttttcttcctcctggaaatcagaaaagccatgaaacttccctgcaaattcctgcacacagcaagactttcacgcagaaatctcatggctttccgtaaataaaatttattttttatttgtacgtcttgcaatcatcggcatgataaagccaagtccaattagtacaaatggtgttacaatatttaagataagctggaatctgtcttcggaatagatacccataatacatgcaaatgctgtaaataagaagcaccatccaccaaatatcataccaactgtcttattctttacaaaatgatactgagccgggaatttatctcctgcttttttcagtgcaatatatgctacaaatacccaaagataacggagtggcatacaaacagagtttacttttaccagccagcgaaccagtgtatccacactgtcaataccaaatgccggtacaataatcagaatggaaacgattaccataactagtttatgtccatttgtgtaagtaccatattcattttgtttaaacattgcttttggaatataattttcatctgcacaatccagcagcatacgaagcggtgcatcaattgaaataatcaataccgtaaactgtccgattaagttacagattgcatataccactacaaagaagttgcccaatccataatactgacctaatgtctggaatgcgtaataagcaccatttgtcataaggtcttccggaatattattggaatcaaacatcatacccattgcgattgttccaagcattgcgcacacagcaaccataattgccagtgcaatcatacccttcgggaaatctcttgctgggtcttttgtcttattaacatatggagaaattttctcacatccacctactgcgaacaccagaatggataaatttaataaaaacttcatatcaaaagatggcatgaatgttttcatagaccagtcaatatctaacacatttgcatttgtaatcgccggtgctgccatcatcattacgatgaataatagggacatgataaacatcgtagagcctgccaacgtagacagtttctttaatacattgatgcctcttgacgctacccatattgcaaataagaacagtaccagacatgcaatctgaagcacttttgtatttacagaactaatacggttatctctaaaaattgcccaactagctgcgataaaagatgcatttggcttctgagaaatgtacggcatatgtacaacccaatatgtccaacctgcaaaataagcaactttcggaccaattgtctcatgcacccaagaactcacaccaccacctgcatctttgaatgcacttcccaattcaccaaccataagtgcatatggcacaaagtaaatcgcaaagataatcacccacgaaataattgcttttaagccgccatactcagaaaaaccattgatgacattaccaaatgcccaaactgtggagaatgccataaaagcaagactgtaccaaagaatttttttgtcacttccaccttgtttcattgttactttccctttctttaactatactttgctattctgtttttaataacaacagtttcaatacaacataaataattatacattcaaagctgtcaaaaaagtgacaaactttcctacttttcgtcaagaagttccatggcaatcttttccggtttaatcggcatctcttctacacgaagaccgactgcattgtaaaccgcattggcgattgccggacacggagtatcaattacaatttccccgattgattttgcaccgaacggatgactcttttcataactcggcttaaattcaacccgaatttttccaacatcgagacgacttggaatcttatactgcataagagaattattcgccattgcacctttctcagtatactggatatcttcaaataacgccataccaattccctgtgcaattcctccttcggtctgcactctcgccaaatttggattaatcggtgtaccacagtctactactgcaacataatcaatcaattctacacttccggtttctttatcaatctcaacttccgccattcctaccatgtaaggcggcggtgaaatctcagcggcacagttttctgtcacctgaagtgcatcattatttccaaatgttccccgaactccgatttccggaagggttacttttgccgatttgtctttcttttctacacattttccatcaaaagttacttcattcggttctgcttctaacatggaagctcccatttttacaattttttctcttaagttctcagctgcttttgccactgcttttcctgtgatataggttgtagaagaagcgtaggaaccagaatcataaggggaaatatcggtatctacaccaaatggaacaacattgttcaaatctgttcctaaaatatctgctgccatctgtgacaaaatcgtatcacagccggttcccatatcggttgcaccaagtcccaacgtataagaaccatcctcatttaattttaaagttgcaccaccaacgtcaactttgaaaattgcagaaccctgcattgccatagctacgccaacacctctaacttttccatttggaagttcttttctcggatacttttcatcccagccaatcatttctttggcacgttccatacattgatccaaagtacagcttgtagcagtcggagaaccatcataagcaataaatggatccccttcacgaatcatatttttctcacgaatcacagtcggatccatacccatcttttctgccagttcactaactgcggattccagcgcaaagattccctgtgttgccccataaccacgataagcacctgctgccatacgatttgtatacacaacatcatatccaaaacgatatgcctctgtatttcgatataaaccaattgacttatgtccggataaagcaaccgttgtcggtccatgttctccaaatgcaccagtattcgataaagtaaataaatcaattgccagaatttttccttcttcatctgcaccgacttttacttttacttccatttcatgacgcggagacgaacaaatctgagattcataacgagtgtacaccaattttgccggtcttccggttttaattgtcacaattgccggataaacttctgttaccagggtctgcttcgctccgaaaccgccaccaatacgtggtttaattacacgcactttagaagcgccaattccaagcgcacgacctaaaattcttcttacatggaatggaacctgcgtggaagaaacaattacaagacgtccaaaatgttccagataagtataactgcggaaagtttccatcattgcctgctgatttgcttttgtatgataagttttctctacaacgtatttacatttcgcaaatgtttcttcaagatttcccattccttcttcagaagaagcacagagatttcgtttattatctgcaccaaccgggaatctggattcccagttatcttccggatgaattaaaattttattatcttttgcatcatgaaaatctaaaatagcatccaatacctgatattttacttttatgattttaagcgccttatcaactgccgcttctgtctctccagccacaatcgctaccgcatctcccacaaaacgcactctctggtctaaaatcagacggtcatacggactaaattccggataagtctgacctgccattgtaaaacgatcctgtggtacatctttataggtaagaatgcaagcgattccaggtactttcattgctgcatctgttttaatttcttcgattaacgcatgcgcatgcggacttcttaaaagtttaacaatcagacagtccttcggtgcaaggtcatctgtgtagaccggctgtccggttaccaatgcttctgcatctttttttctgactccgctatttacatatttcattaggcttctcctttctctgcttttttatgttccagaaattttaaaatacttctggtttgtcccataaatccagaacaacggcacaggttgccagccagatattcgttaatctgctcttctgtcggattctccagttcttttaacattgcaaagatattcataataaatcccggattacaaaagccacactgttctgcaccttcgtctgctaaaaagccaccaaactctttggcttcttcctgcattccttctaacgttacaatctttttgccatccgctctggctgcaagcatactacaagataagaccggcttttcgtccataagtaccgtgcacagtccacagtttgcggtttcacaacctctttttacactataacaccctttttgtcttaataaatctaataataataaatccggtgcgatttcttcctgtactttttttccgtttaaaaagaaattaattttcatttgcatctccttccacctgtacaagtgctctctttgtcagtacctttactaaatggcttcggtattcggcagatgctctcatattgctgccggtcggaaccagtttctgcacttcttctgccagtgcctctacttcttctactttaaatttaaaagaagattctaactctttttcaatcaacattgctttttgaggtcttgctccaattacgattctgactttcttttcttctaatccaactgcacaagtcagcactggaaaatcagtcgctgaatttctctgacttaaatacaccgtatgcatcggtactttttttacaataatgcgtaccagaatatccctgtctttcttcatctgggcaaattccttcattggaataattccacccttataaagttctacataagaatccatcgccagaaacatagtcagtacatcggaaaaaccatatctcccaaaaatacttccaccaactgttgcacagttacggaactgaactcctacgatatgtcttacactttcacacattgctccatttgtataatcagccagtcctttatgaagctccagactgcgaagcgaagtcatacaaccgattctaaattcattttcatcttcctcaatagtatcaagacctaaaccggataaatcaatcgccatgcttacatttcgatttcccatctttaaccagaccataccgccgataagacaggctgttcttttctgatttaactgatatgcctcttcgagactttctacctttgtatactcttttattttcagcataataatcctttccataaaattatttgagtcatttgattttatacaggaaaaaagagtctgaaattcagactctctcccaagtaacattgtcagtaaccttgttcttcttttatgagtatagcatagcaaatggcacaaatgcaacccagtttttttaacattttcagtcattgacatttttcgtaaatcctatacaatatacaatagggtataaaaggaggataacttgagtgttaaaaaataaaaaacagatattactaattggattttctgtcttattgctgcttattgttttgattttcgctttgacttttaaaacttcagccgaaaaagaacgtgaggaacaagcttctcttgatgcggtctctgcatctattgatggaactgttacagcaattacaggaaaaacgattactatttcaacatccgatggtgattctattacttttaatatgcaaaaagtagaactcgactgcaacagcggtgttattccgggaaacaatgtaactttgatttatgtaggtgcacgtaatggaacagataccagtaacgtacggctgagaaaaatcattacaaccgatgataactcagaccttttatcagcaaaactcaaacagacagaagaggaagaccaagaagaggaagacacaacttccacttccagttctccaggatatgataaaccaggagcagatgtcgatgttgaattgacaaaagaaaatgttactgctctttacaatgtaaatgtccgtgcagacgccgacggagatgcacaggtcattggagcacttgacccagatacaactgtaacaagaaccggtatctgcagtaatggctggagccgtatcgaatatgaaggtcagactggttatgtgtggggtgaatatttagaagcggatgaatctgattcttcctcaaattcatcttcatctgatagctcaagcagttctgattccaaaaaaagcagtagttcaagttctaaaaaatcaaagaaatcaagctcatctaatgagtaatacaaaaagaagctcaagaacaatcatcgttcaagagcttcttttttattcatctaaaactataaaatttcaattccagctttttcacaagcttctaatgtatgttcatcccagatacttgcctgtacttcacctacatgtgctttctgaagcagaagcatacagattctggactgaccgataccaccaccgattgtcagcggaagttcattatttaacagcattttatggaaagtcagatttcttctttcatcacatcctgcttttgttagctgttcatccagagtttttgcatctacacggatacccatagaagatacctctaacgcacactgaagcggttcatgccagaataataaatctccgtttaatttccagtcatcgtagtccggtgctcttccatcgtgacgttctccggattttaataaatcaccaatctgcatgatgaatacagtttttttctctttgacgaaagcattttctctttcctttggagtcagattcggatataaatcttccaattcctgggaggtaataaaagtgatgtctctacaaagttctgtatgcagattttcatactgatattttacttcgtctaatgcattacagatagattctacaatacgtgtaaccgtatttttcagataatccatatttctgtcttctgctgtgatgattttttcccagtcccactggtctacataagcagaatgtaaattatctaattcttcatctcttctgattgcgttcatatcacaaagaattccttttccaggatggaaattatagcggtataaagccatacgtttccactttgcaagagaatgtaccacctgtgcttccatctttgcatctggaatatcaaatgtgactggtctttccacaccatttaaatcatcattcaatccagacgccgggtctacgaataaaggtgctgttactctttttaattttaacgccatgcagagttttttctgcatcagatttttaatcataccgattgcttcctgtgtctcataagttgaaaggcaggatttataaccttctggtattattactgttcccattctattgtcctccacttttccaagaatgttatcattttagtacaaaatacaattcttgtaaagacaatagggacggcgttttccgattttttatgttagccatattaatattgcacttattattaaaatagcagccacaattaacgaattttttcttctatttgattcaccgtaatctcttaccaatacacacgctcccgcactaatactcattaataatattacgcgctttcggattattggatttatttctcctactgcaatcatgccaatggcaattagcaccaaaatccacgtaagatttcttaaatatttgtaccctctaatatccattagatcactccaatcaaatctgtacgagctgcattactgtaaaaataatatttgtgatacatacgtggtcttccacccactaactcatctgtataataggtaatatccgtataataaacagttggaagagaacgacttattattacatttgcaatagtaattgccgctgctgctccagcagagccaacaactgctacaatcgcagctacaaccgctgccgtatcacttaaatctgcatttaatgtaccatttctacgtgataattcatgagaagcatataagctgattcctacttcagaatttccaatattttttccatctaatattaagttaccactttgtttattataatcaattacgtgctcaactccatttttgttatagctaactcttctcaaaatttcattttcatatatattatacgttatttcttcactatctattttagtttctattgattcatcaaaaatcaaatcattttcggcttttacaggaaaaacagctacatttacaattgatatgatagcaattaaacaaatactcaaaattttcttagctaattttctcatataattccttcttatatatctaaaatagttttttataataatattatactgttcattggaccttcctcctttttctttatatttgtttaatcttttcgtattttctgatattttatcatttgtaatatttttttctttattttaatattttttattgtttttttcaatcttttattatataaatattatctttttataaaaaatacacaaatataaattatccctcttaggcagttttacatacaaaaaaagaaccctttcggattcttcttcatgtttttcttaaacatgtaccttcaaaactacatatacaaaaccgaaaccatgcagacacttgccgctccactgatttctcagtttctggtcaagccctcgaccgattagtagcagtcagctccatacattgctgcacttccacctctgccctatctacctcgtcgtcttcaaggggtcttacttcctaagaatgggatatctcatcttgaggggggcttcacgcttagatgccttcagcgtttatcccttccaggcttggctactctgccatgcagttggcactacaacagatacaccagcggcctgtccatcccggtcctctcgtactaaggacagctcctctcaaatatcctacgcccacgccggatagggaccgaactgtctcacgacgttctgaacccagctcgcgtaccgctttaatgggcgaacagcccaacccttgggacctactacagccccaggatgcgatgagccgacatcgaggtgccaaaccactccgtcgatgtgaactcttgggagtgataagcctgttatccccagggtagcttttatccgttgagcgatggcattcccacttaataccaccggatcactaagccctactttcgtacctgctccacccgtcggtgtcgcagtcaagctcccttctgcctttgcactcttcgaatggtttccgtccattctgagggaacctttgggcgcctccgataccctttcggaggcgaccgccccagtcaaactccccgcctggcattgtcccaccgccgggtcacggcggctggttagaaacccaatactgcaagggtggtatcccaacatcgactccgtagcaactggcgtcactacctcacagtctcccacctatcctgtacatgcaataccgaatcccagtaccaaactggagtaaagctccatggggtctttccgtcctggcgcaggtaaccagcatcttcactggtacttcaatttcaccggatgcattgccgagacagcgctcaaatcattacgcctttcgtgcgggtcggaacttacccgacaaggaatttcgctaccttaggaccgttatagttacggccgccgtttactggggcttaaattcaatgcttcgtttcctgacatctcctcttaaccttccagcaccgggcaggcgtcagcccatatacctcacctttcggtttcgcatagacctgtgtttttgctaaacagttgcttgagcctattctctgcggcccgcttttacacgggcaccccttctcccgaagttacggggtcattttgccgagttccttggcaatgcttcttccgtcggccttaggattctctcctcatccacctgtgtcggtttacggtacgggtacgttacaaacaatagcggcttttcttgacgcatggctcacacacttccctactctaattcggtccgcatcacgcctttggattgccacacggtttttcctatgtgactcctccttcgcttgccccgggattccattcccgggttgtgctctccacacgtgtccccacagttctgttctaacgcagtacaggaatctcaacctgttgtccatcggctacgtctttcgacctcgccttaggtcccgacttacccagggcagatcagctttaccctggaaaccttagatattcggccataaggattctcaccttattctcgctactcattccggcattctctcttcaatacagtccacagctcctttcggtactgcttcttcccgtattcaatgctcctctaccaatgtattactacattcctcagcttcggtgtcgtgttttagccccggacattttcggcgcaggacctctcgaccagtgagctattacgcactctttgaatgtatggctgcttctgagccaacatcctggttgtcttcgaaatcccacatccttttccacttaacacgtactttgggaccttagctggaggtctgggctctttcccttttgactatccaacttatctcgtatagtctgactcccgataatcaattccatggcattcggagtttgatattcttcggtaggctttgacgccccctaggaaattcagtgctctacctccatgtatctctatcgaggctagccctaaagctatttcgaggagaaccagctatctccgggttcgattggaatttctcccctatccacacctcatccccacccttttcaacggatgtgggttcggtcctccactgcctcttacggcagcttcaacctggacatggatagatcacccggtttcgggtctgcacatactgactctggccctattcagacttggtttccctacggctccacgcctttggcgcttaaccttgccagcatgcacaactcgccggaccgttctacaaaaagtacgcggttccgcatataaagcggttccacagcttgtaaacacagggtttcaggttctctttcactcccctcccggggtccttttcacctttccttcacagtactatgctctatcggtcactaaggagtatttagccttacggggtggtccccgctccttcccacaaggtttctcgtgtctcgtggtactctggatcctgccttgtcctctttcctttcccatacggggctttcaccctctctggctggctttcccaaaaccattctggtagaatcaaggaatcaattccgcagtccgaaccccagcatgcacgcacactggtttgggctctttcccgttcgctcgccgctacttaggaaatcgagttttctttcttctcctcggggtacttagatgtttcagttcccccggttcccctccatacgttatggattggcgtatggatacatgaggtcttctcatgtgggtttccccattcagacatctccggctcattggatatttgctcctccccgaagcttttcgcagcttatcacgtctttcatcggctcttagtgccaaggcatccaccctgcgctctttcttgcttggccattcagatcttatagcgttaacatctgacggctggtgttgcttggtttgtttctatttcttcgctgtatttctacagcgcctcgtttcgtctctatcttacgttttacgtattttagatgtttcgtatatgcagttttcaaggtacattcagatgtaagtttttgtaatgccatgaccggtagaactttgttctggaggttgcgagcatcacactcactcttattcatcttttggctgttttatcagccattcaaacacaaaagctttttatgcttgaatcactggtaaaatcaccatttgcttattttattttttgtaatccggcagccacctgctttcccatgccgtctccagcatagtatcatcggccgcttaagtcttaaccatcgtgttcgggatgggaacgggtgtctcccctaagcgcatcgccaccggaaatgtttggttattaaattttagaagttttccttccttaataactcaacagtgaaacacttcttaactacttcttcttccttagaaaggaggtgatccagccgcaccttccgatacggctaccttgttacgacttcaccccagttatcaatcccgccttcggcagctccctccctaaggttgggtcactgacttcgggcgttactgactcccatggtgtgacgggcggtgtgtacaagacccgggaacgtattcaccgcgacattctgattcgcgattactagcgattccagcttcgtgcagtcgagttgcagactgcagtccgaactgggacgttatttttgggatttgctccccctcgcgggctcgcttccctttgtttacgccattgtagcacgtgtgtagcccaaatcataaggggcatgatgatttgacgtcgtccccgccttcctccaggttatccctggcagtctcatcagagtgcccagctctacctgctggctactgacaataggggttgcgctcgttgcgggacttaacccaacatctcacgacacgagctgacgacaaccatgcaccacctgtcttctctgtcccgaaggaaaggttccattacgaaccggtcagatcgatgtcaagacttggtaaggttcttcgcgttgcttcgaattaaaccacatgctccaccgcttgtgcgggtccccgtcaattcctttgagtttcattcttgcgaacgtactccccaggtggaatacttattgcgtttgctgcggcaccgaagagctttgctccccaacacctagtattcatcgtttacggcgtggactaccagggtatctaatcctgtttgctccccacgctttcgagcctcaacgtcagttaccgtccagtaagccgccttcgccgctggtgttcctcctaatatctacgcatttcaccgctacactaggaattccgcttacctctccggcactcaagaaaaacagtttccaatgcagtcctggggttaagccccagcctttcacatcagacttgctcttccgtctacgctccctttacacccagtaaatccggataacgcttgccccctacgtattaccgcggctgctggcacgtagttagccggggcttcttagtcaggtaccgtcattttcttccctgctgatagaagtttacataccgagatacttcttccttcacgcggcgtcgctgcatcagggtttcccccattgtgcaatattccccactgctgcctcccgtaggagtctgggccgtgtctcagtcccaatgtggccgttcaccctctcaggccggctactgatcgtcgccttggtgggccgttacccctccaactagctaatcagacgcgggtccatctcataccaccggagtttttcacactgtaccatgcggtactgtgcgcttatgcggtattagcagccgtttccaactgttatccccctgtatgaggcaggttacccacgcgttactcacccgtccgccgctcagtcccttacatcttcccccgaaggttctgtcgtaagcgcttcgctcgacttgcatgtgttaagcacgccgccagcgttcatcctgagccaggatcaaactctctgatatagtgtttgtccaagttcaagataactacttggctatctatcccttttactgttttggttcattgaaccgttctttttaaaataaatgaatgtaaaagaattttcgttttcatgtgtttcactgttcagttatcaaggttcctgtcgttctttttatcagcgacagcttctatattatatcaaagctgtttttgtttgtcaagaacttttttaacttttttcaaagttttttgttgctttcgaactttttaactttttgttgcttttatttcagcaactcgtttatattatcatcttttcagttatttgtcaacaactttttttatttactgataatatagtcaaagttctgtattttctctgtcacttatcagcgacaactctgatactatatcacagttgcacaccatctgtcaacatattttttatatttttttacacaaaaagaaactcttaaaaatggaaacgcatttttaagagtttcttctattattatagtatattagtttttgcttatcagcctttaataccagactgagcaacaccctcaataaactgtttctggaacaggaagaagattacaactaacggcactaccgctagtactgctcctgccatctgcattggatactcggtggtatactgtccctgtaaggttgacagtgccggtccaagtgtcattttttccattgaggtgtttacaatcaacggccacataaagtcattccatgcgaacttgattgtaaagattgcaagcgctacgatacctggttttaccagcggaagcataatctgtccaaagacacggaatcgtccgcatccgtctacaattgctgcttcttccagttcttttggtaatgacatgaagaactgtcttaaaaggaaggtaccaaatgcactaaataagtttggcataaacaatgcaggaatcgtatccagtaatcccattttctgaataatctgatactgcggaatcaagaaaatctgtcccggtaccataagtaccgataagattaatacaaacagtgcatttttgaacggaaagtcaatacgtgcaaacgcatagcctgccatcgaacaaaatgcgatctgtacaagtgtcgtaaccgctgtagaaataatcgtattcatataaactgttccaaatggaatcgcagaggatacaattgtatgatatgcagtcgttacaaagttttccgggaaaattgtcggcggaatcttcatcgcttctccggatgttttaaacgaagttaaaatcatccataagaatggaaatactacaacagcaactccagcaagaagaatcagatggacaatcaaatgatttaagtttgattttttggttttcattctcattctcctccttcttaatcataatttacccattttttctgtccaatcatctggattacagtaaccagcatgattgccaggaaaataaggattgaaattgcggctgcgtatcccttatgaccatagtcaaacgcctgtcgatagaacagcataacaaccgtttgcgttgattcataagctggatttgcttttccgaccatcatatataccgtatcaaatacctggaatccactaatgatagaggtaatcattacaaagaagactgtcggtgtcagcatcggtatcgtaattttgaaaaattgcgtaaccgcacctgctccatcaattgctgccgcctcgtaataagatttactgattccctgcatacctgcaagcaaaataatcatgttatatcccactgtcatccagagtccgacaaccataattccaaacaatgcggtatgcgggtctgtcatccagttatgaccttttccgcctactgctttaagcgcactgtttaagatacccatctgttcattatacatccatttccataccatagctaccgcagctgacattgttacagaaggcaggaaatataaggtacgataaattgattttcctttgatttttgcattcagcagagctgctaataagattgataaaaacaatcctaacggtacagttataacaacatattttaaggtattaccaaatgttctccatacttctttgtcacccagcatctctttataatttgccagtcctacaaatgtagacatgttaaacttgtttacatcattaaaactaaaccagaagttctggataaacggccagatatagaacaccagcaaaccaattgtgaccggtgcgatcaagacatatcctgcaaaccagtcttttttctgtcttttcgacgctttttttcttggtacttttgctttcacttcagccattctttcacctactttattactttgctaaaagtgcatctgcttcttttttcagtccgctacaagcatctgcaagtgacatttctccattgtaagcttttgtcagccatgtagattctttgtcatacagttctgctgcctgtgcacaaaccggaagtggataagcttcatctgcatggtttgtataagctgctaagttgtactggctgtttgcttctgcgaagtatttctgagcatctgttctggcggagataactacacctgtctcaccctgaatctgctgtgcctcagcacttccaagccagatagcaaatttttcagcctcttctttgtttttagaaccttcatatactgcatatccaagaccgttgatacagttatcttctacaccattgaatgtaggaatttcaacacagttaattttatctttgattgtatcattagatgcatattccggaaccatgtaagaacctgcaaagttcattgcaagctgtccgccttcaaacattgcatctgcagatgtttctgcaagtgtagctgcacttggtgaaagtcctgcatcaatcatatcaatccagcactggataccttcctgagttttttcatcttcgtatcctgtttctgttgcatcatcatttaaaatccagccgccgtttgcgtatactgtctgataataccatgtctggaagtcaaccgggcacgcaaatgcataagtaccttccggaagtttgtcttttaattctgttgccagagccactaaatcatcataagtcatatcatctgtcggatattcaactccagcctggtcaaacagttccttgttataccataatgcgtttgtatcgaagtctttcggtactgcatagtttttgccctcacgaacatagttgtttaccagtgtttctgaaaaattgtcgttgatgtcagaatcagcgattgccgaagaaaggtcatctaagattccaccttcctgataagcatccagatgcagtacgtttaaccagaatacgtcaggagctgttccgccgcctgctgctgcttctaattttgtccagtattctccacctttgtatggtgttaactgaattttaactgtcacgttctcattttctttttcgtaagcttcaatcagtttttccattgcaggtctctgattttcatcccagataccgaatgttaattctgttttaccttttgatgaaccgcttttttcatcagaagaaccgtcactgcttgaaccgcatcctgcaagcatgcttgcaccaaggattgcagtcattccgaatgctaccatttttttcatgtttttcataatacttctctccttttcttattatgattgttctgtttttacagctatctatgaaaacggttttccgttttacatacttcctttttgccggatatcatccagctcaattacggctccgccgtgtaatcttgattcctccgctgcaagagcacagtaatgactctctacagatttttccagtgaagtaatagaaggactctcttctctgtttccaagtaagatatctacaaattcttctaccattacaatatctccaccgccatgtcctgaaaaatcatcggataattcagaagccggaatcaattctgtttttaattttgccccaaaaagtgtagtttcaatgaaatcatcttccacatcccaggaacccattgttacattcatttcacctttcgttccacaaaactgtgcatgtcttgcaaaatcagcagtgtgaccattcatggaaaaactcattgttgaaccgtctgtcatatttaaatttacaacctgatggtctactacatcgttatcacaatgataaacgcatcttccataaggtccggttttcaatgcttcttctacagattccggtgtcggaatttctgtaacaacatctaacggccagcgggtatttccatttcttgctccaattctctcactgtccagataaatgctttctgcatcataaggacaggtagcttttactttgcaaccatcaagacacctcttcgtacatccctccggtgcattttcttctttaaataaatacgtgcttccaaaagaagataaggatttacattttttatctgccagccacagatataaatccatatcatgacagcatttctgcaaaatcattggacttgacagttctttatttctccagttacctcttacaaaactgtgtgccatatgaaaccatcctacattttcggatgcattgatagaaacaatatctccaatcacaccagaatccaggatttcttttactttacggaaaaccggtgtataacgtaagacatgacagacaacaactttgcggtcacattcttttgctacttctacaatttcacggcactcatcaagatccggcgaaatcggtttttccagtaacagatggtatccctttcttaatgccgggattgcctgcgctacatgctgtctgtcctgtgtcgtaataaacatcacatctgcaagcttctcttcttttaacatttcttctgcacttgtataacatctttcttttggaacgtgatattcctccgctaccatttccacttttttcggattgacatctgcaatcgcaacaatctcaatcttatccggatggatttttgcagctttggcataagtatcttttccccggcttccaagtccggcaagtgcgactgtaattttatttgccatttcttcctcctcttttcttctgatgtagccttaaaatctttctgtattcatatcaagctgtttcaacccacaattgaatgaaattgcttgtgaatcaaagaaaagcgggtagaaacagctatccacaataataactgtttcttatgcccgctttggctccgctcatttttttgatttatctgctttcggaaacaatttcataactctgttttctgaaatcaactcttacttttgtaccatcagaaaaacttgtttcctgtaccatgtaatccccattcaccatctcatgacgcagcatttcacattttgcaactttttcatgtaaatcagatacgattttactgcgctcgatattttctttcagactgagttttactttatcatcaaatgcaccatcaaaattcggatatgcagcatcacgaatcagatacggtgctccgccgtttaacagggcataaagcatataatcatcttcatcgctgaccttatccatcatccatggttcaatcacacaatcatgataaaccagattgtataacggaaccggaacgccctcttttggagttccgggctgtctcatcataaagtcataaggtgcataatggcagaaaaccaaactcggaaccgcccagtcactcacttcttcagaacttggcaggattccacaagaaagcagatactcaaagcattttcctctgaattcatagcagtctcttctggtcatgcgatgttccggattatcacattcatcaccttcattacaggtaaatacgtccagatacgccccatctaattctataccatttcgttttatttctccaaaatttcgttttacataatagcttgcctgtgtcgcacacagataagactgtggaccgcctgcccatctttgatgcttcggaattgttccatccggcagcctgcatgcataattttcatcaaaacttggcgccgccaaataataatcacggtactgatcatggattccaaacatatagccacactcatgcatggtatctgcaagctttttcatgccgtcccaaccaccggcttctttacatgccggaaggtaatccggatgtttattatcatatcccggttcagcccagccgtctaagtgaagataaagttttttcactccggcctcatgaatttcttttatctcctgcacacgtgtctcaaacgttgtcaggtgattatttttatccggattttccggatcaaagaaatcagaattttcctgtacctgagttttgattcctttatgtacaaatgcacatccgattaaatcattaatggatggatttctcattgctttttcagacaaagtacgaagccttccctgctcatttacataccctctgtaaattttacaaagagtattataatcgcagtccgatgcaaatgtataacgcataattctgcgataatccattttgccaagacttggttcaaaataaacccctacgtgtgtatatggtccattcgccggatgattggcataataacctccgttccatggtgtctcacaaattgcaatataaccttcccgctcttttacctgaccaaaccacggcatataaccgcccgcagtttcaaaaaatccattaaacggaattgctcccagctccgtttcccagtcatttggaatgagcacaccctgttcatgtgtcagcagtgtataccattctttgcttggatttgtaaattccattgctccaggccagaacagctttttaatatgaagtccttcttcttttaaaggaatccattcaaaatacacatgtccggttgcatcttcaatccagattaatgtttcaaagctgtatggatatttttttccttctttttcaaaatcagaaaatatacttctgattccgactccgattcccgtctgatacgtttcatgagaaattgaagctgcctcgtcaaagaaaagctctccttcctcacattccatatatggacggaatccttctttccaagaccactttgtcttttcttgttccagtgtcaccatcagacttttttcgtccagactgacagctactgtcccctgttcaatttttctcatagcgtaatcctcaatttctacttttttctactcttttcatcacctttaaatataattaacagtatatacagtttttcggtcaatatgttgccttattaaatacttttcttgtcttattgcatactttttgttaaaatatccgcaggaggaatacagatgacctacattaaaaccacattgaagcgggaaatcgcaatcgattcgattatcacaatccactattttgaatacatgaaagactttgtctttcacggggaatctcatgatttttgggagtttctttacgttgatcagggaagcgtcattgtacaggccggagaaaatcatttccggatggaagccggcgatattatttttcatgaaccaaatgaatttcatgccatacgttccgtcggaaattcttcgcccaaccttgttgttatgtcctttataacaaactctcctgccatgaatttctttcggaagaaaaatttcaccctgaataagtcggagcgcactcttgtctcctgcattttaaatgctgcacgtgaagcccttgccacacccctgcatctgccctcgattgagcaggtgaaactcaaacccaatgcaccatttggctcacagcagatgattctgctctatctcgaactatttttaattacactcgaacaaaattatcttccgcttgatgcaaaaccaccagaacgaaaacgacattttccacttgccactccaatcgaattgtctgatacaaaagcgcagagaatcgaagaaatcattcaatatatgcaattttgtatctgtgaacagctcaatacgaaccagatttgccagcatttttccatgagccgttcctctttacaaaaactctttcaaaaagaaaaaggctgtggaccgatggaatattttaatcgcataaaaattcagcgggctaaggcaatgattcgagatggaagtaagaattttactgaaattgcaggatttctttcctacagctctccccaatatttttccagacaatttaaaaaatccaccggtatgtcaccgatggaatatgcttcttccgtaaaaggaatttctcaggcattaaaaggggatgattagaatctgctctaatcacccctgcttttattttccaaaacttttttgttttcttaatttcacttcttattttacacggaatgctacgacactacatgccggaattgtaaatttcagccctttttctgtgatttcataagcagtaaatgcttcttctgttacattttccggttcttcaaatgtattgtaagcatgcatttcctgatttacaatacttgcactgacgtcggatggattcaattctgtaaatgccacttctacttcttcactgtctgttgtagaaagattatttaaggtaattgtaacaataccatctttatcgattgataccgattcctgtaatttcggcacctgatattctttttcccctgcatctaaagtagagtttcctgtaatacagctttctacgaggtctgcatcctgatggtgacgatactgatggaatacgtgataggttggtgttaaaatcatcttttccccttctgttaaaataacagactgtaatacattgaccatctgtgcaatacaagccatttttacacggtcacagtgtttattgaagatgttcaggcttaaacctgctactaaggcatcacgcatcgtattctgctgatataagaatcccggatttgttcccggctctacagtaaaccagcatccccattcatctacaatcatgccaacctctttttccgggtcgtactgatccataattgcaccatggcggttaattaactcttccatgtacagagctttccataaagttttgtaccatactttttcatcaaaatcagttgcgcttcctttaatttcccatccttccggatgtacataataatgaagagaaagtccatccatgaatccatgagccattggcggctgtggtgctgcataacaagtttttaatacgccctctgtccagaaataatctgcaacatttgcacctccgcagactttcttaatcggtgcggaattgtcataatgacgaacataagtctggtatctgcggtataagtttgcatagtattccggagtcatatttccaccgcatccccagttttcatttccgacaccaaagtaatcgattttccacggtttctcatgtccgtttgcttttcttaaatctgccatcggagaaacaccgtcgaatgtaatgtattccacccattcgctcatctctcttactgttccgcttcctacatttccgtttacataagttttacaccccaactgttcacataattcaaaaaattcatgtgttccaaagctgttatcttctaccacaccaccccagtgtgtattaatcattttctttctgttttctttcggaccgattccatccatccagtgatattcatctgcaaaacatccacccggccagcgcaaaagaggaatccgcatctcttttaatgcctctactacatcggttctcattccgtttttgtttggaatcggagaatcttctcccacataaattccttcgtaaatacatcttccaagatgttctgcaaaatgtccataaatttccggattaatgtgtccctgtttattcttttcatttacatataattttgccataaaatcctcctgacttttactcctgtactctcggaattttcacctcagtcggtaagcttccgacttaagatagctcctccatgggatgcgcatctttcttctttccatcactatattggatgttgacttcgattgcaagtggtttctgaattttttgctgatttcgggcttttttgccccattttccatacaagtcgtccaacatcctataagttgtatgtgattttcgtcaaaaaagaagccctgatacaagttttttcactaacttgtacccgagcttcttttcttagtttttactcattctaaatcactgtcaagcggatattcgcaatccgctttcgctatttggttaaaaaatcctaatcttaagcatttaatggatatttatctgtcagctgttttacaatcgcttttgcttttccaatattttccttatcttttaccataagtgcaattgcctctgcaatctggtccatatcttcttcattcattccacgtgaagttactgctgctgttccaagtctgacaccacttgtcacaaatggagattcagggtcgtttggaattgcatttttattacaggtaatatttgcttcatcaagcagattctccattacttttccggtaattcctgttcctcttaaatcaaccagcatcaggtgattctctgttgttccggaaacaatgttaatgcctctctttaagagtccgtcgcacaatgcttttgcatttttcacgatgttctgctgataaactttgtattccggtgaaagtgcttctttaaagcagaccgcttttgctgcaattacgtgcatcaaaggaccaccctgaatacctggaaatactgctttattaaaattaaactgttttgcaatctcagcactgctcataatcataccgcctcttggacctcttaatgtcttatgagtggttgtagttgttacatgcgcataaggaattggacttggatgtacacctgctgccacaagacctgcaatatgagcaatatcgaccattaaatatgcgccaacttcatctgcaatctcacgaaatttcttaaaatcaatcacacggcagtatgcacttgcaccggctacaatcattttcggttttgcttcaagtgcaatctttctgacttcttcataatcaatcacaccttcatcattgactccataaggaacaattttaaaatatgctcctgagaagtttgccggacttccgtgtgaaagatgtccgccatgtgcaaggttcattcccattacggtatctcccggcttcagcatcgcaaagaacactgccatgtttgcctgtgcaccggaatgaggctgtacattcacatattcgcacccgaagagttctttcgctctctcaattgcaagacgttccacttcatctacacactcgcacccaccatagtaccgttttcccggataaccctctgcatacttattggttaaaggactgcccatagctgccataactgccttacttacccagttctctgaagcgattaattcaatatgggaattctgacgttccacttcatctgtaatacacttcgcaatttccgggtctactgcctgaatctcttcaaatgaatacatgttttctaacctcacctttcttatcatttcattctttacttttttaccagattcttcgtattgtggatatttgtttctctcacaaagacattctctgtgtaaaaaaatgcccagagccggaatcgaaccagcgacacgaggattttcagtcctctgctctaccaactgagctatctgggcttgtgcgaaattttcttgaatttcgacaacacagccatcttaccatactctatttaaaatttcaagccccttttttaatttattacgttaaagtcaagcggacattcgcaatccgcttcgctacttgctcatgaacgcagtcgcttagtgctctgcgcacttgaagcgggggaatgcttatctgcgttcaaaaactttttatttcccccaaaaaccctcctacttttccacctcctgtgaaatgttgtaattatgcataaaatgtggtatcctaaccacgataacacaaaaatttttaacgatacaagggttaatgaaattatgatgaatatacgaagattaatagccatctggagcggtcgtctgattaaaaccgcctgccagattaccggaaaacagggtgttacgctcgccggaaaagtcgcactctccatctatccgccaatcttaaaagaactggctgccgaagtgcgaaaagacacttttattgtatgtggtacaaacggaaaaacaactaccaacaacctgctttccgattttctcgtctcaaacggaaataaagtggtctgtaatcacaccggttctaatatgttaaacggtgtagtatctgctttcgttttaagcgccagattaaatggacacttagatgcagattatgcctgtatcgaaattgatgaagcttctactgtccgtgtgcttcctcatttcaaaccggactacatggttttaactaatctatttcgtgaccagcttgaccgctatggagaaattgatatcactatgaatctactctcccgcgccatgaaaatggcaccaaatatgaagcttttagtcaatgccgacgattccctttctacttatctggcaatggataataaaaatccatataccacttacggaatcagcgaacaggtattcaaagaccagaattccaaagaaatccgtgaaggtcgtttctgtaaacgctgtggtcacaaaatggaatacaaattttatcattacagccagctcggggattattactgtccgaaatgcggattcaaacgtccaaaaccggaatttgatgcttctcacattgatatgtccgacgggcttgcttttgatgtaaaagcttcccatatcaaagccaactatcgtggattttataatatttacaacattcttgccgtatttggcgcagcttccatggcaggaatcccaacaaaaaactttaataaagtgcttggagattacactccgcagtttggacgaaacgaacagttttttatcaatggcacgaaagttatgttaaaccttgccaaaaatccggccggatttaaccagaacatcggtgcagttatgactgataccagtccaaaagacattattattctgatcaatgataacagtcaggatggaacggatgtctcctggctctgggatgttgactttgaccgtttaaaagatgccaatgcaagctctatcaccgtaacaggaattcgaggagcggatatgcgtctgcgtctgaaatatgttgacattgcttctgatttggaaaacgatattgaaaaagccattgaatccaaaattaaaaatggcacaaagaatctttatgtactggttaattacaccggactttactctacacacaatattttaaagaaaatggagggaaaaaagtaatatgaagcttacgattggacatttatatcctgaccttttgaacctctatggagacaggggcaacatccagtgcatgatgaagcgctgtcaatggagaggcattgactcagaaacaattgagttcaccttagaagataaaattgattttaccaaacttgatattgtactgcttggcggtggttctgaccgtgaacagatgcttgtatgcgaccgcttaagaacgattcagaaaaattttcatgattatgttgaagacggcggaagcgtcattgcagtctgcggtggttaccagctcttgggacattattatgataccgatgagggacgaatcgaaggtctttcccttgttgacctctataccgaacagggaaatccacgtctgattgacaatatcgtacttcaaaatgatgcctttgagcatccgattgtcggatttgaaaaccatggtggacgaacttacattggagaaaaccgccccttcggaagagtactttatggtcatggaaataatggagaagatggcacagaaggtgtgctttacaaaaacgtggtcggcacttatctgcacggaccattgcttccaaaaaatccacatatcagtgactatctgattaaaaatgctctaaaacgaaaatatggcacggatgaacttacaccacttgatgatacacaggagttagaagcaaatgcttcgatttatcagcggtttgtaaaataaaaaaagatgtgggaaacctttgaacgaaactttaaaggtttcccgcatcttttatttattctgtttctatttactttattttttctcaattttccgaagtaacggaagtgtaaatttcgcatcaaagaacgaaataaacggacctaagcaaaatgcacttaacagtgtaccaatcccaacgattcctcctgccagaaaacagataagcgcacacaaggcatctgtcgaaattctgtgccagaaatatgaaatcgatggtttgcgcattgccataatcagcgacatactgtcataaggcgcagcgccaacatccggtgtctgatacatggatacaccaaaactgcacacaactactccaatacagacaacgattaacctctgccacatcacttccggaattccaattccgttactgagcagattataaaaaaatgtcactatgtatcccaaaaacaatgcgttgactaccgttccggctccgatgaattttcgaccgaaaataatttcaatcacaaaaaccgccagattaatcaataccagaaaattcgcataagccattcccacgctgtctgaaagtgccattaccatcccgctgtacgggtcatttccaagaccggaaagtttaaaaaccgcaatcccaagtcccaaaaagatatttcccactaccataaccagaagccgtccccatccggctttttcaaaataccttcttatcatttttctttttactcttctttcatttttttgactctgttaaactcttctaagatttctttttccggagcttttgtacacaaactgaaaatcacaatgcacaaaatgctgattacaaaaccagttgcaagagagtataaaccagttgcaatacccagagtctgtccattaatgaacggaatataatcccagataataacggttaatcctcctgacacgattccggcaactgcgcctgcaaaatttgttcttctccaaaacaatgacatcagtacaatcggaccaaatgcagaaccaagaccagcccatgcatttgataccagtcccataatactgttgtccggattccatgcaattgcaaatgccagcactgcaaccacgataacggtgacacggcttacttttaatactgttttttcatccgcctgaggttttaaaatatctttataaatatcttttgaaacggaagacgcagtgactaggagctgagaatccgcagttgacataattgctgccaaaattccacataagaataccccaccaataaacggcagacgtaaatcctgtgtaaatatctttgtaatcatctcaataaatacactttctgttgaagcctgaccttccgttcctaaaataaccggatacagataagctcgtccaagcacaccgattgccactgctgcaaagagagacagtgctacccatataatagcaataactcttgattttttcaattctttttgattctttacagccataaaccgggtcaaaatatgcggcattccacaatagcccagtccccatgcaagctgagagaaaatttcgataaaagaataagaactttctccatttcttgtcatgcttaaatatgcctgatgtccgccaatgacctggctttcatctaacatggcatttaaatttccacttccaataaaacaatacgcaagcacaggtacggcaagcagcccaaccagcatcagacttccctgaataaaatcggtcacacaaactgccataaaaccacccataaacgtgtaagcaagaataacaactgctccaattgcaagtgcaatgtgataatcaattccaaatacggaatgaaataattttcctccggctgataaagcagatgccgtataaaccagaaagaatattacaattacaatcgaagatactaaaagtaatacacgttttttatcgcgaaaccggttttcaaaataagccggaagtgtcaatgaattatttgcaacaattgtataccgtctcagacgagaagagatacagacccagttaaacaccgttcctaaaaacaaaccgacagcaatccatgcctgaccggttccaagtgcataaacggttcccggcaatcccatcaagagccagccactcatatcagacgcctgtgcagacaaagcagccacccatccgctcagtccacgtccaccaaggaaataatcttccgagttttttgttttcttcatataaaccgcaccgataactaccattaatatcaggtaagctgcaaatgccgctaatacgacaacaatatcattctgtttcatcttttttctccttattctgcttctgtcttctgcacgcctcaacctttgacggcatgcatcaaagattggtttacttctgtttctgtgcttttcgacgtccggaaagttctgcaactgcagtataaagaacgtctgtagaagaatttaaggctgtttcacaggaatcctgaatgactccgacaataaatccgacaccaactacctgcattgccaaatcattggaaattccaaataaactgcaggcaagcggaaccaaaagtaaagaacctcctgctacaccagatgcaccacaggcactgactgcggataatacacaaagaataattgctgttggaaaatctacagaaattccaagcgtatgagttgctgcaagcgccagaatagaaatcgtaacggcagcgcctcccatattaattgttgctccaagaggaatggaaacagaataagtatctttatccaaaccaagttccttgcataaattcatgttgaccggaatatttgcagcagaacttcttgtgaagaatgctgtgattccactgtcttttaaacatttaaatacaagcggatatggatttttacggattccgatataagtaatcagcggatttactaccagtgctacaaataacatacttcctactaaaaccagaatcaaatgtccataactgagcagagcatcaattccctgctctgaaattgttgtaaataccagccccataacaccaaacggtgcacaactgataatccatcttacacactgagaaatcgcatcggaaatatcagtaattgcctttttcgttccatcccctgcttttctaagtgcaattccaagaagaaccgcccaggaaaggattccgatataatttgcatttgcgatagcatcgatcggattggatacaatattcataaacagtgtctttaaaacctctccaaccccacttggagcactgacatcctccacacctgctgtcagggtcagttccaccggaaacagaaaacttgctatcactgcaaccgtacctgccaaaaaagtaccaagcagatataatacaacaacggttttcatatttgtcttttttccctctttatgctgacacaacgcaccagacacaagaaagaataccagaatcggagcaaccgcctttaatgcaccaacaaaaagctgtcctaaaagcccgattacggaaaactgcggaacaaccataccaagaataataccgataatcaaaccggcaataatcctttttaccagactgatgctgttccactttgtcacgagttccttcattttgtcttttctccttttttcctctgtaccctcgctctcctcatatcacaaaagtacatcgctttatcaatattcgctcatcattttatcacaatcggctcaagaagcaaagcattttgtctttctccgcaaaatttttgtccttgtaacgaaaacacgcaagattctctgtgtattttcgctgttttttcgtgtttcttttagagcgcgagacgttgcagaacgtccggtggacgttcgctttgcaacgaccggagcggagcggagacctcgaaccttcgagccccggcggggctcgaaaacacaaaaaagatggtatccaaccggataccatctttttgtgtttcttttagagcgcgagacgggactcgaacccgcggcctcgaccttggcaaggtcgcgctccaccaactgagccactcgcgcaaagagcgggtgatgggaatcgaacccacatatccagcttggaaggctggtgttctaccactgaactacacccgcaggttatttaattgttgctgtctcgttaagacttgtttataatacctcaaattgtttctattgtcaacactttttgaaaaatttttttaatttttttttaaagggactgctgccttatttccaagactgcaatccctctctttattatttatgccagaccatgtacttcaagccaatggtctaatgtttctttattgctcttaattcttcttgcacgaatctggaatacaatcaatgtaagcaaattaaatactacaaaccagataagcagataaatcactgcgttcataatactttcgccacctgcgattgtgcttctgaatgcctctactgtataagtaaacggtacccagtcatgcaggtattttacaaagtcaccggaaacttcaagcgggtaagtaccaactgaacctgccagctgaattaccataaataccaacattaagaaacttccgacttttccaagtgagtttgtgaagaagtacataattgacataaatgtcacacttgccacacaaacaaacgctaatgtcttgccaatttcaagtggtgtaaatccatcaaatacatgcagtaatgcaatcattacaagaccctgtaataaagcaattgtataaagtacagaggctttgctaatccaccaggagaatcctgattttaatttgcctttgtaacttgtcagaggatacattaaactaaatgcgatacatccaacccaaagaccaaccgacatcatatatggtgccattgcgtgtccgttgttttctacggttgtaatctttgtttcacttgcctctaccgggcttgagaacatgtcataagtattgtcgtctgccttggtctctttgacttcttttgctccatccgcaaggcttgttgccaatgtgtcacttccatcataaacttgatcaagaccatcgcctaattcttcacttccgtcacgaagctgtccggctccgtcactaatttgtgctgctccatcactcaactggctgacaccgctaagcagtgtactattatttgctaccagctgttttgttccggatactaaggttgttgttccatcttttaactgacttgcgccatcataaagctgtccgcttccggaagataactgttttgctccatcatctacctgtttgattccgcttgagagtgttcccattccgtcatctaaacttccggctccatcgtctaactgtttgactccgtctaccagtgtcggtacagcggatttcaaagttccagttccttcacttaaactgcctgctccatcgtctacctggctgattcctgctgcaagggttcccattccggtatctgctgcttctgcacctgcgcttaatgcttttgcgccggtgtttgcactctggatacctgctaaaagttgagatgcaccgctctggattccgcctaaggcttctgacttaaactgagttccgcctgctgctacctgctggattcctgctgtcagtgccggactctgttctgcaagctgttttgttccggctgccagtgtctggcttcccggaagaatctgagtacttaatgcactgttaattgttgaaattccagttgtaagtgccggtgcctgtgctgtaatctgctgaacaccacctgtataactatttacaccagtttttaaactgtcacttgctgatttcaatttatcaaccgtaacaattaactgttgtaactgttctgcgcttacttctgcctgtgcagaagttgaagtgtttgttgttgttgtttcaacgcctgccactttgtcaagctgtgcacttgcattatcggctgctgatgaaacgttctggcttgcacctctaagtgtttctgctgcacttgcactctgggatgctacatttgcaagctggctgtttgcgtcatttacagatgctgcatttgcattcgctgctgcaatcgcctgatttgcaatgtctgctacctgattgatatcaccatttgcaacggctgttgccagtgcttctgataatccatcaactgaagtaaccgcttcctgattggtgctgatgcttcctacgctgtctgctgctgatgaaagtgcatctgcctgactctttaatccattcactgcatcttttgcaccagatacatctacgctaacttcttttgttgtgctctgtgaagtctcgtttgctgaagcagttgttcctgccatctgatgaagcattgcggaaagctggctaagaccatcattaattcctgttgctcctgctacaagctgtttggagtttgctccatctgttccatttactttttcaagtcctgcctgtaatgcttttgcaccactttctgcacttgatgctcctgcagttacctgctcgagtcctgccgaaagctgagatgctccattatttaaagctgtggaagattccggaagacttgctgtgctttcctgtaactgattaagtcccgcacaaagttttgccattgcctggtctgctgtactgattcccattgtcagagaagttccaccggcttcaagctgttctgttccggctgcaagctgacttgctccagtttttaaactagctgttccagtttttaattttccagaaccatcaactaactgagaagttccaccctttaactgaactgcgccatctgcaagtgcatacacaccatcctgtaaggttggcacctgtccatttaactggtcaagtccggtctttaatgcactggaaccatcttttaactggccggaaccagatactaactgagaggttccagatgcaagctgtgcggttccggttttcgcagttgcaataccgtcttttaactgacctgctccactgtcgagctgtgttgctccactgccaaccgtactgacaccatctacatactgctttaatccaacttcaagtgtatcactaccatctttaaaagtaagtgaactgtctgctaaaacattcagattttcggaaatggtattatttccatcgactaactgtgtaactccgtcttttaactcttcagagccatctgccgcttcctgcattccatctccaacagttacaatctgatcaaatacagtttctacataagtctttgttacctcttcggccacactgtttttaatcttttccattgcagtttcactcattttagaagcaatgtagtttgttcccggattggtatcataatcgagttccattttctgaggttcttcatccataactgtggatgcattttctgagaagttttccggaatcgtaattaccatgtaataagttccgttttttaaacctctggctgctgtctcctggtctacaaagttaaaacaaagagaatcctcatctttcagcttatcgactaatttctctccgactttaagttccttgtcattgtaggtcaccggtttatctttattgactaccgctaccggaagtttatcaagatttccataaggatcccacattgaccccagaaaaagtgtggtgtaaatcgtcggtattgcaataacagcaattacaaccactaaaagcaacttattcttgaacaagcttttccactctttccctagcatatacattcccctttccttattcagttttctctttcggatatttgttatctttgaaatgcttatcatttctaaaagataattgataactctgtttctttctacgtcaaatcgcttatccgatttcgatttgtttaacgtactttgaatagtttaatagatattgtgttgattttttcttcatgatgaattatactaaaggtgcaacagtgatacaaccatcaataactagtttttatgtacattaatagacattttttatcatttatgttgctttttcttcaaaaacctgagaggagtcttatatatggaaaagaaaactgaccgaagagtccgaaaaaccaaagctcaacttcgtgccggacttgcgaaattgatgcagacgaaaagtatcaaagaaattacggtaaaagaattagttgatgaagttgatattaaccgttctactttttatcttcactacacagatatttaccagatgttagaatcaatcgaggatgagcttgagggggaaatcaatcagattgtaaataatcatcctgtggattcttattacaaagaaagtttccctatgattaaggaaattttagaagtattatgggataaccgcgatatctgcaatgccctgcttggttcaaacggagacatggcatttgtgcttcgtatggaatctattatttcacaacacagcctgcatgttctgactacaacatttgctacagacgtaaccaatattaaatatgcttatgccttttgtctgaccggttgtgtgggtatggtcaaatcctggctggaatctggagatactacagataccccgcttcaaatggcagaattgacttatcatctgattatgaatgcactcaaagatatcaaacgactgccaagtacaactttatagcttaaatcaaacatatacgcaaaaaggttcagaagaaattcaacttcttccgaaccttttcttgtttctttttcattttttaaaaatcaaatgtcgccgttttcgtatttcccatattccatttattacgaagagtcacatacaattctgcatttgttgcttccacataaggttttacatagaatactactcccagaccacaggtcactgcaccaagcagtccccaaagaataaacgataaatccagcacaaatgtattcatcttttctccatccatcatctcacggctgatgcggattgcatcccgataattaatatccggctgttctgccagaatatatggaaccatgcggtaagaataggattttacaattcctggaattacaaacaaaagtgtccataagaaaatatataaattctgcatgaacattaccattgccacatttgcaaaatttccattctgaaatccaaatcctatctttgaaacaggtgcattatagtctcgattttcaataaaaaagcgaactgctccaaccatcaatacatttaacacaaaaatctttaaaatcagaacaaataatgtaactccacccacaatcggcagtgaaatatctgcggaatagctactgtcatttacgacaccattcactgtgcctctgacatcataactgccacctatcgaagctgttgcaattgtaatcatcaaacctgctaagacagatgctgcgtagtttctatggaagcaaagttttcctctttcttttaagtctgctctcgtccacataatcattctccctttttatctcaatattcgacttgaactttattttatctccgctgttgcttctttgagccattctttttcttctttgttttccaacaatggctctactacttcatacacatgtttatgatattcatttaaccattttaattccgtttctcccaaaagttccggaatgattgcttctcgttcaaatggcacaagcgttacgacttcaaagttcataaactgtgcatagtcatttttttctgcttttttgcacatcagcaggttttcacagcggattccgtattttccttccagatacagtcctggttcatcggaaatcaatacgccttcttcaagcggaatcattccacccggacggattccactgttccagttgatgttctgtggtccttcatgtacatttaagagatatccgactccatgaccggttccgtgattgaaatccagtcccgcatcccacagtgcacctcttgccagtatatccagatgtgcaccgcctacgccatacgggaattttgccattgccagacgaatatttccttttaatacaagcgtaaaatgttttttctcttcttcgcttaacggtcctaccgcaatcgttcttgtgatatccgttgttccctgccagtactgtccgccggaatcaatcaggaaaaatccttttgattccacttttgcacagtcctcttttgacggtgcataatgacacattgcagcgtttgatccataagcacagattgtttcaaaacttaaatccagacagtctttatcttcttcacgaaactctctgcttttttctgcagcattgtattcatccactgttccctctggcaccgttttctttaaccagtaaataaatctgcacattgctcttgcatctttgatgtgcgcaatgcgttcattttccatctcaaccgcatttttcattgcttttgccggtttggtcggattcatcgcattgactgtggtaacttcttctggcagattttcaaataatgtatagtttactacaccttcatctaataaaatcttactgtcttttgcaagtgtttttacttcttcataaatcgcaaagtatgggcggagtaccactccggctttttctaattcgttcttgatttcatcagaaaccacgccatcctgcacatagaaaatgacttcgtctgctttcacaatgacataagaaagcacaaccggattgtaaataatatcgtttccacggatgtttaacagccatgcgatatcgtccagactggataagatgtgcacgtcagcttcatattttttcattgctctgcgcaccatctcgattttttcttctctggatgttccaacatattttatatccacaagataagccggttctttggacagttccggacggtcattccagatgccgtctaataagtcttcctgacaatagaaccgtcctcctttgtcttccatcatttttttgtatgcttttccctgtgacacgctgatgactcttccgtcgcaggcaaggcaggaaccttttgccaggttcatttccagaaattcatcgactgtcggaacgcctggttcacgcatcttcattaaagtaactccggtatcttcaagttctttcgctgcctgaataaaatatcttccgtctgtccataaatatgcctggtcatcggttacaagcagtgtacctgctgaaccactgaaaccagaaagccattttctggctttaaaataatcccctacatattcagactgatgaaaatctgctgtaggaaccaaatacatatcaatgtttaattcctgcattttttcctgtaattccaggattctttctctgttctcactcatgttaaaaacttcctctcttgcttctatctcttacttctatttactgaattcctttcatagtaagggaaattcgctttttcttttcatccacacttaacactttgacttccacgatgtctccaacgctgactgcttcaagtggatgtttaatatatcggtctgtcatctgtgaaatgtgtaccagtccgtcctgatgtactccgatatccacaaatgcaccaaagtcgatgacatttcgcactgtaccttttaaaatcatgccttcttttaagtccttcatatcaagcacgtcagtacgaagcaccggttttggcatttcttctcttgggtcacgtcctggttttccaagttcttttacgatatcacgaagggtcatttctcccgttccaagagactctgccatctttctataatcttttacataaaatgcaccatgacctttgaaaatatcttctgcagttgttcccatattttccagaaatttttctgctacttcataactttccggatgcacactggttgcatcaagcggattgcttccccctgtaatacgaaggaaacctgcacactgttcaaacgctttcggtcctaattttggtacttttaaaagttcttttcgactctcaaaacgtccattttcctcacggtatgctacgatattttttgcaatcactttgctgataccggaaatatattcaagcagggaaaccgaagcggtatttaaatcaattccgactttattcacgcagtcctctacaactccagacagggcttcccctaattttttctggttcatatcatgctgatactgtccgacacctatagatttcgggtcaatttttaccaactctgcaagcggatcctgaagtcgtcttgcaatggaagcggcacttctttgtcctacatcaaagtttggaaattcttcggtagccagtttacttgcagagtatacagaagctcctgcctcgtttgtaattacatactgaaccttctccggaatttcttttaaaagttccacaataatctgttcggattctcttgaagcggttccatttccaagagaaatcaggctgacattgtattttttaattaattttttcagagtttcttttgccgacgcaatcttagcgggagtggtcggtgcagtcggataaatcacaaccgtatccaagacttttccggtttcatctaccactgcaagtttacaaccggtacgaaacgccgggtcccatccaagcactacttttccaacaattggcggctgcatcaacaactgctgaagatttttcttaaagactttaatggattcatcttctgctttttccgtcatgctgtttcggatttctctctcaattgcaggtgcaatcagacgattataactatcctcgattgcttcttttaatacgtcctgtgtatttggattttttcttgtaataatctctctttgaagatatcctaaaatttcttctgtcggagcttcaatttttacgcctaaaaacttctctttctctccacgattaatagcaagcacccggtgtcccggcattttttccacacgttcttcatattcataatatttctcataaacagatgtctcttccggtttttttgcagttgaaacaagcatgcctttcctgaaagtacactcacgaatttcactacggtaatccgctttatcggaaatactttctgccacgatatcttttgcaccggaaatagccgcttccactgttgtcacttctttttcttcggatacaaatgccttcgcttcttcttcaagggatttgtctgtcatctgtaataaaataatgtttgcaagaggttccaaccctttttcttttgcaatcgttgctctggtacggcgtttcggacggtatggacgatataaatcctctaccacaaccagcgtctgcgcttctaaaatctgtttctttaattcttcagtcagctttccctgttcttcaatactggaaagcacctgagttttcttctcttccagatttctaagataagtcagtctgtcgtttaaattacgaagcacttcatcatttaaagcaccggttacttcttttcggtaacgggaaataaatggaatcgtatttccttcatctatcaattttacagcagcctctatctgccacttttccacatttagttctttggtcaaagctaaaataatgtccataattttctccttttaaatcaagcaattcttgccatttgctttctttctaaccttaccaacctatgacagttttgtcaagaaaacaaaaaacgcaatgaacttttttattaaaaatccactgcgttttactcctcttgattttgtttttgaatttgatttcgattgcagatttccagacctgcctttaaaaatacttccaattccttttgtaaatcagaatcaaattcctgccatactttatttaaactgctaatgttttgtacatcctcataaaaaacaacagatggcggataacccagattctgatacaacactgccagaagttctgcattaacacctaatctgcctttttcaatttcacgatacctttttgtcgtaatatctaaatgctgtgccatcttatcctgtgtaatatcacttgcttttctcatccaataccagattgttcttgaatccgtctctttttcaaaagcagaataacggagcagtctgatttctttggtataatccactccatttttctgttcttttcccgaaatattgataccctgctctattgtccagaccataagctgtaagaaatcgctttttatttctttcttacagacacccagatagtgatttaatatcgtttcttcacattcctctcctgtcagcagataatccatatcacagccatgactgtcaaaatttttgagttcttctgctgaaataatggtctttccctgttccaacttactatagtggctctgggtaacacccatcatctgactcatgctcttctgattcagttttctcttttgtctgtacatctgcagtctttgcaatactccttcgtatgcactgcccatagtgttacctcatttccaacggtcaaatttttcttatctttttattgtaatatttttcaaactgcccttttatcccctatttttgactattctgataatttttagtcaattttaagagattgacagctttcatcccaaacatttgcctgacacataaggtttctgcgcactttaagcggcggaatgcttatctgcgttcaaacgcttgccctaatcggtacaacgtgttaaaatgagcaataacaatttttttatttttgagaaatgaggtttttacaaaatggataatttttataattcaaatgataattttccgccacagacaccgccttattatgaacagcctcagcgttatcaaggcagttcgagctgtgcctccgcctctttgattcttggaattctttccctgttatcaatctgctgtatgccaccgcttgcccttgtttttgcaggacttgccttgattcttggtgcactttccaaaggcgaccgaatccgtccgcaaaatgcgcgtgtcggcatgattttatcaggtatcagtttaatagctgttttaattttgcttgctgtatttctggttcgattcacttcaaattcgaccaacaccgaatttttcaagcaatatctggacattatcgagcatccggacgattattccgaaaatgacatctacaattttctgtatgattatctttatccaaacgccggttcagattccgatcataactatgaaaattcacagccttatcactacgatcatacgccttatgatggagatgattccgatggctacgactattactatgaatatccgactccacatcaggaagattccgggcatcataatgtaatttaaccaaatcaagcaagtcccttctgataagcgcgtagcagctatttggttatgagcaagtagcgtagcggattgcgaatatccacttgactaaaacaaaaaaatcctgctttgaggaatcgaaaacctcaaaacaggatttttatttttctaatctgatttttccagtctaatttttttattttaaattttcatattcttttgtttccagttcaattaccggttcttcttttttgtcaaactcaccttttaaatccagataaaacgctgccatcgttgcttccatataaggcatcagccataacagaccaatatagcaggtcagcatacttgccagaagcagtggaataaaacttaaattaatatagaaataacgccacttatttcctttcataagggaacagctttttttcattgcatccactgctgataaattgatatcatccaataacagataatccgtaacagccaaaaacagatttaaaaccaaagctactattgtatccacacacattgcaagtacagaaagccagatataagaaatactgctactgtctgtccagagtggaatattaaacggcagaccaattacaaactgtacaatcagaataatcaggtgtacaataataaaacggtctggatgatgcgtaaatgcaaatgccaggtcttttccttcaaaagactctccacgacagatatttaccatcattttactatatccagccttcaacacgctgacaagaagtgaaataacatacactaaaatctgcgaagtaaccagtcccattgttgtaccggtacccatcgtagaagaaataaaaaaagagggaagaaaggaacaaagtccaagcagtaaaattcctgccatcggagttccataatttccactcagttgctgtctcgcaatcagcttaagagaagcagaagttcttttcataaaataaagtctccaatcttttgtaattaactgtttatttcaattgtccatttcaattagtgtaagattattttttcattttgtcaagaaaagaggatatattccattatgcataaacaggaagaaaaaaatctatatctcttagggtggattttactcggaatttttctaagttatttattgatagcaaagttttcccatttcagaaccttctttcatctcccctgtctcttccgtaccctgaccggatattactgtccgggatgcggcggaacacgggcatgtatcgcctttttacatggacattttttacgttccctgctctatcatccggttgttccttatacagcagtcgtatatttgattttcatgatcagtcacagtatcgaacttttatcaaaggggaacttcgccataggtttaagataccgggacaactatattaaatttgccggtatcattattttagtacaatggattttacggaattttttgaaatggaaatggggaattgatgtgcttggaaattaaaaaagaggctgtttttgacagaacagcctctttcattttttacgctttaaaacggattctggagatgatttccggaagttttgctgcttttgcttcgtactctgcttcgcttaacggtcctgtgataattgcaaattcgccttccacatccggaacggatacagtttttactgcaccaaatacagcttttactgcatctgccatttccgcttcctttccttttatacgaaccaggaatggatgaaccacttctttgatatccattaaatctaatttttcactgttccagcttgtcatcacattttcgtgaagatgttttgcacaatctacaacatctcctacaactgcgcttgctgtcggaagttttcctgctccacttccatagaacattgcatctccgagtacatttccatgtacgaagattgcattaaagacatcatttacactgtaaagcgggctgtctgttccaacaagtaccggacttaccatcgcatagaatttatcattttctttcttgcttgtcgcaagcagtttaatgctcatgccaagtgctgaagcatacttcatatcttctactgtgatttttgtaataccttctgtgtaaatctcttcataatttacatggtttccaaatgccagagaggacaagattgcaatctttctgcaggcatcatatccctctacgtctgcttccggatttctttctgcataccctttttcctgagcttcttttaatacttcttcaaaatctgcattctcagcctgcatttttgaaagaatatagtttgttgtaccatttaagataccggaaatctcatcgatctcatctgctgttaaagaagagtgaagtggacggataatcggaataccaccgccacagcttgcttcaaacatatagttaatatttttctcttctgcaattttaagcagttccaaaccatgtcttgcaactaattctttattggatgtgcagacactctttcctgcctgaagtgcacgtttggtaaaagtatacgccggttctacaccacccattacttccactacaatatctacttccgggtcattgataatggtttcataatcatgaaccaaaactttttctaccgggtctcccgggaagtcacgtaaatctaacacatatttaatgttgacttcctgtcctactcttttattaatgctctcatgattggtgttgattacttccacaactcccgagcctactgtaccatagcctaataccgcaatctgtatcatctttcctctactccctacctaagattttcagatagtgaacgccctcgatgtgttcaatctccgccaccattgcttctgcatcaccctgtgcaggcaaaatctgtacacttaatgtaagactggcaattccgttaatcggaatactctggtgtacggtaagaatattgccatgatagtaggcaatcgtttttaatacacctgagagcagtcctggttcatcatccatctgaagaataaatgtaatattctgtcctttggttttttcacgaaaaggaaagatatcatctttgtatttataaaaggaacttctgctgattcctactgcttctacggcttcctgtaccgttacagtccgttttgactccaaaagtttttttgcctctactacttttaacagtacttccgggactgccttttctgttactacaaaataccttttattatctgacattcgcttcccctttgtttgttccaaaaatacatttgtgtttctccaaaagatattaacacattcttgtatttttatcaactatttttcttatttccaagcgcaatccattttagataagcattgataaaacggtcaatatctccatccataactgcatctacatttccggattcctcattggttctgtggtcttttaccattgtgtatggctgcatgacataagaacgaatctgatttccccagccaatttcagttaattcaccctgaataccggaaagtttctgctcctgttcctgctgctttaacaagtacagttttgctttcaacatctgcatcgccttatctttattttggaactgggaacgctcgttctgacactgtaccacaattccggtcggaagatgcgtaatacgaatcgccgatgaagttttgttgatatgctgtccacctgctccactggaacggtaggtatcaattcgcaaatcatcatctttgatttccacatcaacatcttcttcaatatccggcatcacatcacaggatacaaaagaagtttgtctctttcctgctgcattaaacggagaaatacgcaccagacggtgtactcccttttcggatttcaaatatccatacgcattttccccattaatctgaatcgtaacagatttgattcctgcttcgtctccatccagataatccagtacctcagtggaatagccatgacggtccgcccatctttgatacattcgataaagcatgcccgcccagtcgcaggattctgttccgcccgccccggcatgtaaggtcaaaatcgcattgtccttgtcgtattcaccggaaagcagtgtttttacacggattttttcaaaatccgcctgaaattcatcgagcatatcctgaatttcaggaatgaccgaagcatcattctcttcgtatcccatctcaatcatcagctcaatttcttctttttgtgtctctaatttctgataaatctgaatatcctcttttaaggtactcagctctttcatcattttctgggaacgctccggattatcccaaaaatcaggagcttccatttctctttctaattcttcgacccttttttctttgttagcgaggtcaaagtgaatccctcacttccactaatggtccattatagccgtttaatgtatatttaaactgatctaattctaccaatagcttcacctactttcatgaatatttttcttatttttattcctcatcgatttccacagaaaccatataaatggaaatctgtggctcgacttttattaccgtaccgcttaatttcttaagtggacgttttaaattacttgacattgcaatggcatctttaattgtataataatacatctgtccggacatggtactcgcacagtcctcttttaattctactcggtcaccctcttttaccagtccttctctttccattgtaaattctacaatctgtcccatttgttcaccttccggttttttgtttttgcccgttctcttttatctgtatctgctttagattctttttctgccacagcactgtttatattttttaccgcttccacatgggcatgggtcatttggataaattttgttttcttctctttgaatcggctttttcggaccggattcatctttatttgtaccggttacctgtgcaacctgttctctttctaccttctgttcaattcttacatgatacagcagacgaaccgttgtctcctgaatgttgttaatcatgttatcaaacatttcataagcctgcattttgtattcgactctcgggtctctctgaccataagcctgaagtccgataccctgacgtaactgatccatatcatcgatgtgatccatccatttctggtcgattacttttaagaggataacacgctctaattcacgaagctgttctgcttccgggaattctgcttctttttcctcatagagtttgacagcagcttcttttaattcctgttctacctgttttttctttttgcctttgacatcttctttggtcagagcttttaatggaatcgtcggtaagagtacagaattaaattcttctaaatcccattctgcggtatctacatcatcagagaagcacatttctactgcatgttctacggtatctgtaatcatcttatagatagaatcacgcatgttttctccgtccagtacacggcgtctttctttgtaaataatttctctttgttcattatttacctggtcataatctaacaggttcttacgaacaccatagttatttccttcaatcttctgctgtgctttttcaattgcattggaaagcatcttatgttcaatctgttcattttctgcaacaccaagtgatttgaatactcccatcagtttttcagaaccgaacagacgcattaaatcatcctccagagaaatgtagaagcgagattcacccgggtctccctgacgaccggaacgtccacgcaactgattgtcaattcgtctggattcatgacgctctgtaccaataattttcaaaccaccggcttctcttgctacatcatccagcttgatatcggtaccacgacctgccatattcgtagcaatagtaaccattccggcttcccctgcatgtgcaacgatttcggcttctttctcatgatattttgcatttaatacctgatgagggattccttccctctttaacattttactgattaattcagaggtctcaatggtaatcgtaccaaccagtaccggctgattttttgcatgtgcttctttaatcgcctcaacaactgcatggaatttttctttcttggtcatgtaaacggcatcgtcatagtcaatacgcgcaaccggacggttggtcgggatctcgataacatccattccatagatttcacggaactctttttcttctgtcaaagctgtaccggtcataccggatttctttgcatatttattaaagaaattctggaaagtgattgttgcaagcgttttactctcacgtcttacttttacatgttcttttgcttcgattgcctgatgcagaccatctgaataacgacgtcccggcataatacgtccggtaaattcatcaacgattaaaacctcatcgtcttttaccacataatcctgatcgcggaacattaaattatgagcacgcagtgcaagaataatattatgctggatttccagattttccgggtctgccaggttttcaatattaaagaatttttctactttatgaacaccctgttctgtcaggtttacgattttatctttttcatttacgataaagtcaccggtctcgatgatttcctcacccatgatagctgtcattttggtcatttcaccactggcttctccgcgctctaactgtcttgcaagaatatcgcacacttcatagagttttgtggattttccactctgtccggaaatgataagaggcgttcttgcctcatcaattaataccgagtcaacctcatcgatgattgcatagtgtaaatccctttgcactaactgttctttatagattaccatattatcacgcaggtaatcgaatcctaattcattattggttacataagtgatatcgcaggcatactgtgcacgtctctcatcatttttcatggaattgagtacaacacctaccgtcagtcctaaaaattcatgaacttttcccatccactctgcatcacgatgtgccagataatcattgactgttacgatgtggacaccttttccctccagtgcatttaagtaagccggaagggtagataccaatgttttaccttcaccggttctcatctctgcgatacgcccctgatgaagaataattccaccgattaactgaacacggtagtgctccatatttaatactcgctttgctgcctcacgtacagttgcaaatgcttccggaagtaaatcatccagtgtttcgccttcttccagacgttttttatactcccttgttttcccacgaagttcttcatcggaaagcgcctgcatagatggacgaagggaatcaatcttatctacaatcggcatgatacgttttaattctcgctggctgtgagtaccaaacattttctcaattatattcatacttaattatactcctgattttattactagcttaaacataagtgtcatactataagcgtatctacactataccacagtactatttattgtatcactttccagtaacgaaaacaagggcaggaattatgaaattcccgccctcgtagctctgatttttaccagttaattactaactgctttgtcatctttcctgttaaagcttcacttctcttatccggaccgtttgttccgacaaagagaacactggaagaagaatcgaaaatcttttctccttcgtcatttacgactttataagcttcttttgaaactgtaatggtcagctctttttcttcccctgcttcaagagaaacttttgcaaatccgcacagagccggatttaccggtgcatacttagaatcctgattcttgatatacacttctactacatctcttgttgctacttcagaatgatttttcacggtaacgcgaatttcagcatcctgctctttttccggtgcttttgcaaattctgccttttccacctgcacatccccatagcttaaaccatatccaaatggatataatggttcttcggtcagataacgataagttctgcccttcatagaataatctgtgaaatctggcagttgatctaaggtacgatagaaggtaatcggcagttttccacttggagaaacttcgccaaataagatatttgccagtgcttttccaccctgtgaacccggataccatgcctgaatgactgcctctgctttttcttctgcctcagaaagattcatggcacttccggtaaagttgcatacaattacttttttaccggtttctaatactgcatgcatcagtctctgctgactctttggaaattcaagattctctttatctccggacgcataagcatttccggtatctccctcttctccctcaagtgattcgtccagaccaatacatagtacaaccacgtcactatgctctgctacgctgagtgcttctgcaattctgtcatcttcctgtgcaagcgcttcttctttatccagaaataaatgacttccttttgcatacatgactcttacatcatcgccgacatagtcctgaattccttcaagtactgtaatataacgggaagctgttccatgataatttccatccagagagcttctgttatctgcatttggtccgataacaccaataatcttaagttcttcttttttgagcggtaagattccattattcttaagaagaacaatgctttcttctgctgcttttctggaaagttccagatgttctttggattctactgctgtatacggaatcttatcaaattcggtctcgtcgaacattccaagcagaaatcttgtagtaaagagacggattgcagcctcttttactttttcttttgtggtcagtcttttatttaatgcttcttttaaacacagataagtacagccacaatttaagtcacagcctttatttaatgccagtgctgaagattctacaccgtttttggttaccatatggtgttcatggaaatcacggactgcccagcagtctgacacataatgaccttcaaacttccagtcttcacgaagaatgtgttccatcagttcttcacttgcacagcacggttctccgtttgtacggttgtaagctcccatcactgcttctacatccgcttcttttacgcaggcttcaaaagctggaagataggtttcatacatatctttcttgtttgcttttgcatcgaaagaatgacgaagtgcttccggtccggagtgaactgcaaaatgttttgcacatcctgctgtctttaaatattctccatcaccctgcagtccttcgataaatggaactgcaagtctggatgttaaagtcgggtcttccccataagtttcatgtcctcttccccatcttgggtcacggaagatatttacatttggagaccataaagtaagccctttgtaaatgtctctatctccatgctttatagactcattatattttgcacgtgcttcttctgaaataacagaagcctctgccttcattaaatctgtatcccacgctgccgccattgcgattgcctgtgggaatacggttgctgtaaccggctcttgctactccgtgaagtccttcattccaccagttatatgcaggaattccaagtctttcaattgccggagcatcaaattttaactgacttgccatctcatctactgtcatctgtgaaaccagtgcttctgcccgttctcttgctttttttctgtctctcatctttttcctcaattcctctctttatttaccagcagactattttattagcagactttaattacaccttttacgatatctgctttattctttacgcaggaatccagtgcattctgaatatcatctaactcaaagtagtctgttacgatatctttgatattgatttttccggaagcaactgcatcgattgccatcggataaatatttctgtaacggaatacagttttaaatgtcagttctttgtcaagtgccataccgattggcagtgtcatttcaccgcttgcactgtatccgacaaatacgatagttgcgcctttatttgcaccttttattaactgggaagctgtaatctgagaacctgcggtttcgattccgaggtcaaatcctcttccacctgtcagttccataatgcgggcaaccgtatcttcttcttttccgttgataactgctgttgctccaagttccaatgctttctgcagacgtttttccataatatcaactacaattacattagatacacccattgctttcaaagaaagcagagttacaaggccgatgcatcctgcacctgtcacaactgctgtctgtccaagatgagcgcctccctgatttgcggcatgcataccaactgctaatggttcaattaatgcaccttccattgtacttacgttttccggaagtttgaaacaaaggtcagcttcatgtgcaacatactcctggaatacaccatctaccggcggagttgcgaagaatacaacgtctttacacagattgtatttaccctgtttgcagaattcgcattttccacaggtttttcctggctctaaggcaactctgtcaccaacttttaagtgttttacattttcgccaacttccacaacagtaccacctgcttcatgtcccagtacgaaaggagtttctacgataaaatctccgattcttcctgattcatagtaatgtaagtcagaaccacagattcctacatattctacttttacaagtacttcatcactcttcggtgtcggaacttcacgttcctgaatttctactttctgtaaatctgtcattactgctgtcttcattttcattttaactgccattgtcttgttcctcactttctttttttatttttctattgataatgttactctgctacattctttttccccgagataagaagtgtctctttccatgtcttttggataaacaaccaatctctccaatacaagtcccgcttctcttgcggaaactgtaattttattcaaaccttttttcaaagcaatctctgtacttcctgcatgttcctgattcaaaactgcctgttcccatggaatgcagcccggttctccacctttatagccatcctctgtaaatgtaaccagcttatccacctcgccatttacagaaactcccatagaaagttttcctccataaatcagtggatttgcaggagaagtataaagttttaagatgcactctttttcttcttcactaaagagttcatacgttacagacggagcattttcttttgaatcaaacgccgccgttaccggaaatgccttaattccgctttgatatttcccaaagtcgtataactctttaaattctacagtttctttctcatatgttcctgcatttttatctgcataatgaattgcatcgattacaaacatgccatgttctgcaagaaatgcacctttcggaagtgcactggtatcttttttcagtgcttttaccagaaccggaacaaactcagtttccgtcttaatttcaaaactgcaggatacttcttctccaagcggaaggttttcttcttttaaagaaatttcaacttcgtcctgaagtgcagtctctccggacattttggaaaattccagccattcgcatgaagtttcatcctgagattcatgtgcaattccatccaatccgacttttcttgcgccttcctgtatcttccattttacgcttccctgaccaccgttagcaatttgaattttagcctttttgctagaagaaactacgaaatcatcaatcacaagtgtaatcgggaaatactggttcgtataatgctgggttttatctgctcttgtcacgaccagcctcggttttttcggaagacgaattacgtgacgcaccggatatctccagtcttcatcattccagtttgtaaatccaatatgagaagccaattccattcctgcccattttccatctttaaatgctgccatctgagcttttaaggcttcatctttttcaatacaagcttccactaacttgtcatactcatttgcaactgcctttccctgagaagcatataagtggttttttccagaataaagatgcattttcagtaaattaaaggatgcttctgctgagaaataaatcatgctgaagtaagcatctcccataccacgctcctctaaagttttccacagcctttcattcttttcttcgagttttccacaaaaagataactgtttttcacattctaagtaatgtgccggatggtaaaccgtatcatttaaagattccggttttcttaatgcattgatttttaaatagccttctaatacttcctgaatttcttctcgctcttcttttgaagtatagcttccgaacatggatgaaatccatgctttggtatactcttttgtgctgtttggagcagaagaaccccatttttcaaaatcatatgccaaatccataaagtaatttaacggaaattcctggaatttcacatctccgacattgacaatccagagttctcttactccgtattcataagcttctgtcatctgctcccaaatcttggaaagttcggtagaagaaacccattcataagaaacagggtctccatgataatccagatggaaatacattccaaatccacctttatgatttctctcaaatgcttccggaagtgctctcatatttccccagttgtcttcgcaaagcagtaaggttacgtcctcaagttcttcaaatccacgcagtccttcttcgcttccaccaccaaaatagtaatcttctacttctttataaactgcaaataactgcggaactttctttccgtctgtttccagatgttcatgaatcatctcacgctgttttgtaataatttcttttaacagacgtacattatcggaaatcagagaatcttcgcccagcatcttgctgtcgttttctcctctcattccgactgttggaaatacattgtgaccgatgcttcgtttcacaccgtcctcccagaatcttaagattccttctttgtttgtcacatagctccatgcatctccatacggacttttcggtcctctcaccttgctgtattctgcaccggaacgcatacaaggttcatgatgagacattccgatataaattccgtattcatcagccagtttcatagactccaaatccggaccgtctaacataaagttttccgcccacatcgccggccataaataatttcctttcatacggaggaggtattcaaaaatatggtcatacatttttgcattaaaacttccaaaatgagaagttgcccagtttccacaacatggccattcatcattgatgaaaaatcctctgtatttcacagacggctcttttgatacaaaagaatcctcttcttttaagataaaagagtcctgtttcacgtactggcagtctccccagtcaaccattgctgtcacacctaacaactctgacagatgaaacagtccataaatggttccaagtttatcacttccgtaaataacaagtgcgctttcaattccttctaccggattttctgccacaataaacgcataagattcccgttttccttctacctgtccaagttttgaaatcttactgcacagtgtttctgccagttttccgcttcctgcagtcactgcaatcactgcctgttttgccggtacagctgtttcacagatttcaggacaaaatgagagtgtcccctctacatcttttgccactttgcctgctacttttttcacaccgattccacattcttctggaattacaaaataaagtcccttattctttgaaatttctaatgtagccatacatcctccaggtttatttccatgttttttgttctaaaaagaacccgacagcttgcgctgccagattcttttctctggttactgcttattttaattatttaagaaggtcttttgtatcctgataaatttcgtttgcttcgtctacgtatttctggctgcctttgttttcacagtcttttacgtaagcatcccagtctttatccagatcacgtttaccagtgatgaattccagagctgctgtatttacatagtccataagaggagtcttaactaagttcatttcttctttctgcatttcatcagcaagaattggtggttttaattggatatcttctttgcttgcatttactctttcgttccattctttttctccatcagagaatttagaatactgaagttctttagaaccgccgtaagcaaatacaccattaccaaatccatagtctacgtttaactgtttttctgcacctgggttaataccattgtagtagatgtcagagtttaatacgatatttccatcatcatcttttgtataggtttcaccttcaacaccccacagacataaagtctgtccttcgtctgagtaccataaccagtcgatgaaacgaagcattttgataaatccttcttcaccaagttcatctaaagcattctgagtaatcataataccattttcaagacgaccagctgcgctggaaacttttaactgtcctgcggaacctgccggaggagtcaggaagtataattcagctccatcgacctgcattttaccattctggatatcagaataaatctgatagttcatatttaaaacataagaatcaccacggaagaattttgcctgcgcctgcgtggtatcctgtgtaaatgtttcagggtcaattaaaccatcttcgtacattttgtggaacattgtgaggtattctttgtattcgtctgttgtatcagcgaagtagaattctcctttatcaaagtcaaattttgtaccatcttttaagccccagtcaccaccgtcattggagtaaccacctgttacattataaactgttgcagcgatattcatggtacttccgaacccaaatccatcagaccatacataatctgcttttgtatattcttttactttctttaatgcttcataaaagtcatcccatgtccaggagctttcatttgaaaggtctacacctgctgcttcaaatacatctttacgaattgcaagagagtaaccaccggctgttgtctcccacatacccggcagacgatagtatttaccgttggatgccagaatctgctgtaagtcgtcttccatgccccagtcttttacgcatttttgatagttcggcatgtactgaacccagtcactgattggaacaatctgaccgctgtcttcgtaagcagtagaatcataagttttcggaataatgtaaggagcactaccactgtttacagaagcagaaactttatcattgtagtctgttcttgcaacgattgtcaggtcaaatgttacatttgttttttcttcgattgctttccaaagtaaccagtcctcattgtaaggatagttttcatggtcagagtacatcatggaatattttactgcttcgtctgaatggaaagtttcgtcttctccataagtgtaatcaaggtctttgtctgcatcttctgctgaaagagtcggtccgtctttgctgtctgatgatttgctgccgccacagcctgctaatgtagtgccagccatagctaacacaagtgtcattgctacgagtttctttttcataattacctccttaagttatgattttttaacgtacgtttaatcatacgcaattcacatagttaaattataaatttccttatatgcgggtacgccttggcgtaccctgttaaaacttgttaagtatcagccttttactgctccgattgtcataccctgtacaaagtatttctgtacgaatggataaacacagataatcgggatagatgttaataccatggttgcagattttacagttgcctgtacactacttgcatcggaagaaccgatttccgtattatttgccccctctactaactgtcttacatacagagcaaccggccatttgtcttttgaatctaagtacagcattggcgtgaaccattcattccacatggttaccatatagaacagacacatggttgcaatgattggtttggataacggaataatgatttttaagaaaatctgataagtattcattccgtcgattgctgctgcttcttcaagttcttccggaagtcctgcgaagaaagatttcataaccagtaagttgaatgtactgattgcatttggaagaatgattgaccacatactgtcctgaagacctaaccactgtgtgattacgatatagtttggaatcataccacctgcaaaatacatggtgaatacaactaacggtgtaattactttgtttaatcttaatcttggctttgacagcggatatgcaatcagcgctgtacatgctacagagataaaagttccgactactgtataaaaaatggtatttccatagtaacggaagaactgattatctcttaagatatatttgtaagtgtttacgttaaatccgattggataaaaagtaacttttccggcacttgcagcagcatcactgctgaatgactgtgctacaagatatacaaaaggatacagggtaataaagatgacaaaaatcataataatcgtattgattacctgaaaggcacgatatccttttgttggtttcatattgttcattttcttcctgtactcctttctaccataatgatgtttctgtaaatttcttagataagaagttcgcagatgtaacaagaatcagaccaattacaccttcaaacagaccaactgctgcggcgtaactgaagttaccacctgtaatacccattctgtataccaaagttccgatgatgtcggctctctgctgattcagtgggttgtataataacaagattttctgcatattacttgatgttacgataccaccgatatccatgattaacagggtcatgattgttggcatgattcccggaattgttacatgaataacctgctggaatcttcctgcaccatccatagatgctgcttcatataattcagtgttaatacctgtcattgctgccagataaaggattgtaccccatcctaatgcctgccatacaccagatgcgatgtatacaaaatcgaaccaacctggttcagacataaatgcgattttatcagctccaaacatctcaatcaatttgttgattggtccttgtgctgctaacaattcttttaccataccacagacaactaccagtgagataaagtgtggcagataagaaattgtctgcacggatttcttccacattttctttctgatttcattcagaagaagtgcaaagattaaagtaaccgggaaacgcactaataaatatccgatacttaatctcagtgtgttccaaaatgcctgccagaactgagggtctttgataaactgttcaaagtaccgaaatcctacccaatattcaccaaggatattcggacctcccttatagcgtctgaaagcaatgatatttccgactaccggtacatacttgaaaataatgtaatataaaagagggataatcattaaagaatataatctccactcttttttaatatgtctcagcagtgaatgttcttttgtattaactgctatctgacccgactgcggaacctgtacattgtctttctgttttttcatttcattgctcctccctttcaactaaactttcttgtgttccacttgataaaccaattatatcgtacggttagcgcttatgcatttctttttttgccattattttagcaacatgtgcataatacttgtatgtttttatgcattttcccatttggctagtcacatattgctaaaaaatgcccaatttttgctatttcttctggctattttctatatctttcctcataaattgctcacatcttgcgaattaacaccttaataaaaacaaggactgcctgtttttcccatgcagtccctatcttattttttatgcttcgcaaaaacagatactcgtaaagttaaagttgcttcccggaaggaataccagacttacatcgttaactccgtaaatcggttctatctcaaagctctgtttcgtctttgttcccataaattcaaccattctctgttcttcaactccatctttggcaaatttcagaataatcgtattcttttcaagcggagtacttccacaaattacaagactctttgttcctttttcgccaaaatccatctgctcaaaacgaatggtaacgttatttccaatctgatgaatttcttctcctgcacgttcaaagctgtctccgtaaatcttgtcacattctcctgccacaagtatctgccatgcacgattatagcgtttaaaccagaatcctttgatatgaaccttcgcacgaagtacaaagcagatttcgctgattccacgcaatctcttattcaaatggaaagtttctaactgataaacattccacatttttggcttttgataaataaatttgccaagcagactgcctccttcatccggcatgccttcataaatttcgatttcataagggtcatcggtcagtgcaaaaaccggaacggtaatttcgtcagaaccatacacgccaaagtcaatatttctaaatccaacctgactttctccatctcttgcagtcgccactccatgttcattcccgtttccgatttcacctttgctgtagttatataaaccggcacttacaaattcataagggtcggtaaaggcttttccaagtcctgtaataataaattccagggaagaaataatacagatatggtctgttccgctctttgacatacagcgaagtctgaaattcccatcactctttgcggttacttttacgcgaccgtccccgatttcttcagttgttgcaatctttaacggaatccccgcatcatctacaatactccagattaattctttatcttttgcatttgccggactaaaatgtgcttttacgatcgtttcctgattttcttcatgcagatgcagaccattttcgctttccagataaatgtttctcacttccacatcctctgttttttccggttctgcttttcttactccttcataagcaagcagactgattccttctcttacttttgcttcttttaccggaatgaccagttcttttgttttcattcctgcactgctgacacggatttttaaatctcctgctttgtcttttgtcttaaatactgctaagagttttccgctgaataaccttcgacttccggaagtatactgctcggtatcggtactgtctccattatctgttccaactaaaactccggcgccttccgcttcaatccagacacggttgtttgcattttgaaccggatatccgtctttatctctcattgaaatttctacaaataataaatcttcaccgtctgcaagcagttcactttcggatgcgtttaagcagattttttccgcatctttaaacgaatgttgaacatcttctgcgatttcatttccttcttcgtcacaggcaaccgcacgcagttcgccctcttcataaggaatctgccagtgtccggcaagctgttttccactctttgcatctaatgtacagattccctgactcttgccattaaaaatcaattccacaaccggcgcattggagcagactcttacatcaataaactgtccgtcattaaaatcccagtatgggaaaatatgcacaaatggttcttttctataatcgacccatcccgccttatataaatagaaagaatccttaaaaaatccagctgtatcaatctgtccaaaataagaattttttgtgtgatacggagtcggctctccgatatagtcaaatccggtccaaataaactgtccacaggaatacggatgttctgcttctgcctgaatacatgcttcaaccgattttgcaccccagcttgttgtggaatttccaagagcagaacactgctcatcttcatctgtcagtacagactggcggtatgggaaatgatagattccacggctctgtacaatcgaagcagtctcacttccataaatgacccattccggatgatttttatggtggtctgcataatatttctctccatagttatatccggcattttttacgatatccgcacatttctgtgcattttcccacggcatatagttcgaaccaatcgtcacttcggcattgtttctcgggtcgtattttcgtacttcttctattaaaatacgagtccagtactgtcccttatcaccgacatgggtatcataaatttcgtttccgatactccacatcatcagacttggatgatttctgtcacgtttcacccagtttttgacatctctttcataccattcagggaaaaatcttgcataatcatacggattcttagaagattcccacatatcaaaagcttctgtcacaatcaaaagtcccatctcatctgccagttccatgacttccggtgccggcatattgtgagaaagacggactgcattggttcccatctcttttaagagttcaaattttcttctcattgcctttttatgaaaagcagttccaagacatcccaggtcatgatggtcacagacaccgtttaattttacttttcttccatttaataaaaatccctgatttggattcaattcaattgtacggaaaccgacattctgcacttcctgctcaattaattctgttcccttatataaagaaacgattaaatcataataatccggatgttctacatcccagatatccgggtggttcacttttgcctttaaataatgcacataaataccgtcttcttttgttatggtctcttccccggcaagtttctgaatcgtttctgaattttttgcttttaattcataaactacctgcagttcgcttgttgcttcaacctcggcatcaatctctacctgccatacattttcctcttcttttttggctgaaaaataaattccatctgatacaaaatgttccaaaggaagcctctttaaccatacattacgataaattccggctccggtataccaacggctgtttggagtctgaaaagtaatcgatacaaagatttcattctcgccgtcttttaacaggttcgtaacgtctacttcaaatgtcgtgtatccatatttccattctcccgcctgtactccatttacatagatacggctgtccatgtaaattccatcaaaccgaagtacgaccagttcttcttcctcttttgtccagttgaatttcttgtgataccagcccattccgtcttcgtataaattttccacctgggaaatcatccagtcatgcgggattcctactgcataaaaatcctgcatttttttctgtacctgttctaagcttgtctcaaggggctgtttacaaaactcccatccatcattaaataatcgtttcatctgccgctcctgttcctttacttttttctatccgatttaatcttaattctctactttatttctatctcaaacggagctgtcaaaagtccttctttattttttaacagaccatcaagtggggaatccttccatgcataacgcacttttttaatttcttctccaaatacttttactttcgtatcttcaatttccgcttttgccggataaaatactccatctgcttttgcagtttcaaattcatttacgctgtctccacagacaatttccagtggctgtccatcctgtgtatcaaaaataaattctacgccatctgctgttttttcataagaaatcagctttggtccttcactgataatctcttctttgtacatcacttttcttgctgcaagataagcacggtgtgccacaccttttttattaagcggatgcaaatcattgtattctcccaaatctaagtttacagtaactgccacatccggaagttctgctgcatttttctgggcttcacgaatgactgcccatgcgccgtctccacggttatccattccacaagccggaagctgaatcacaataaacggcagttcttcctgtttccaatgtgctctccagttcaaaatcatcttctgaatcaaatcttcataactttccggataccactcattggattctccctgataccacagcactccttttacggtcatgttggtacacggtgcaaccattccctgatacattccggttggctgtcttgtaataaaggtaagtatcggagcctgttcgctgactacacgcacctgatagtcccatgttccacgaaggctgattttttctcctgattcaaaacatacatcacaaggtttatccggagtgatacgaccttttccgtcacgacactccagacggataaagatttcattttctcctgcctttaaaagtccctccggtaccggataaattcttggcggaaaacaataaccggtttctcccaccttttctccgttgataaagatacggtcactatccacaagcgttcccatttttaaaattgcagattttcctgccagttcttttggcacttcaaaagttctctttaaatgtagtaatccactgaagttttcaagtccctgtttatcaaaccagcccggaacttccaagatgttccacggtgcatcctctgtctctgcctctttctttgaaagcagttcatgccatgcattttcttttttatcctgtgcactgagcagattttcaatatatccgtcttgtgcaaaacgctcttttacttctaaaaactccgggtaatctgccaaggcttcttcactcatccatgcttctaccggagttccccctttgctgatgttgataattccgaccggaacctgctcttttttctgaatcatatctccaacgaaatatcccagtgcagttgtctcttctagtggcattcccacacattcattccagcctgcttctttatgttcttttaatgcccctgtaaacaccggacattcttccactttatactggtgtaccattgcatttcccggttcatccggaaacatttcacgcactcttgtaatcggaagttccatgttagactgtccagagcagacaaatacatctcccacataaacctcttttacgactgtctcctgtccatcttcactttttatgctcaacacataaggaccacctgttttttcacaggaaatttctgtctcaaatgttccttccgcatcacatttggttctgtaaactttctcctgaaatgtaacctcaagctctgcctgtggtttgtaccatccccaaattcttgttttttctccacgctgtaatacacagccttcctgcagaagttttggaagtttaattgactgactcataacggtctccttttttctactctattctgaatttactcgtttctttattttacccttatcataaaggattccctgtaaaaattctcccttaatgttgccgagtgtttcccgattcttgctttctttttatacaacaaaaataagaaccccgaaaatgggattcttattttttcctgcacatctcatcggtactgctttttccacgatactccgatggtgaacatccttttattgatttaaaggtacggttaaatgcactaatcgaagaaaatccggagctcattgcgatttccgtcacactttctccggtcgtactaagcaattcctctgcctttgaaatccgcttctgattcagatattcatagaatgtcatattcatacactgcttaaaaatccttgtaaaatggaacttggaaaatccactgaattctgccacctcttccaaagaaagagcttcctgatagtgctgattaatataattacaggcactcataatcgtttccatatattcctttttcttttccggattattttctgtgcgcaaaacctgatttttattctttcgacctccgcttataacatttcgtccgatatgtacaaatatttcaattaattttgcgtaaatgactgcattaaaaaatgccttttcctcatcatactccacaataatggaatccatctgacgttttacaaaactgtataatctctgcgtgtcttcttcctctgataaatacagcacaggcggaagcacatttaacagtgtctccatttcttttaacgaatataataagtagtcactgaattgtaaaataatacgttccccagttggcggtgcttccaatccatgcagtacacccgggttgataattaaaatatctccttcttttaaacaatactttttacttccgataatcacgttatatccttcatgaatcggcataatgatttcaattgcagtatgccagtgctccgggtaatcctcgtagtctacattatgaaacaatctaagtcctaatggattaccatagttgattgtctcgtgtgttccctctaagatttctatcatccttcgtatccaccatccctatctcatctttatagattttgttatcaggttctctataactagtatactagcatggtagttttggaaattcaaggtacttttttcattttgcacgcaaaaatagagactgtagaacttctccacagcctctatccatagcctattcaatttttaatctttcattcttaatcttcatcagagaaatccggttcaatcagaccatacgtgtttccttttctcttatacacaacattaacctcttctgtctctgcatttaagaatacaaagaaattgtgtccaagtaattccatctgtacgcatgcatcttccggatacattggtttaaatccaaattttttggtacgaatgattttaatttcacttgtatcatcttcgtagtctttttcaataaattccggctggaatgtttccacgttctgtttcttgttaataatttttgttttgtattttcttaactgtctttcaatgatttcttctaccaggtcaatggaaacatacatatcattgcttacctgctcagaacgaatgatattaccttttactggaatcgttacttcaattttctgacgttctttttctacacttaatgttacaataatttctgtatccgctgtaaaatatcgttccagttttcctaacttatcttcgactgctgttctaagtccgtccgtaatatcaatgtttcttccgcttataataaatttcatgctgtccaacccctttaacgtgtattttacaggtgttttactttcgttcctgtaatgtaaatctattatatcaatattcagtcaattattcaacagtttttagaaaattttaactattttatcttttttgtatacatcattattatgtaaacacagttgcagtctgattgcagctgtgttaaatcttctttattgattatttttattgttattcaaattattgttatcattattattgttgttcccgtcttctgtcaaatcattgatgccgtcttttaatccttcaccgatatcttccacgccatcaccgatgtcttctccaatatctccgatgacaccgtccccattattattcctattattatcattcctatcattattcatagtatcatcattcgtcgtaccattatcatttgtcgtactatcatttactgtatcattttgatttccgcctgtcgcatcattcatgttatttccacatgcggtcataacaaccatcattcctgcaagcagtaaagtaaatacatattttttcatcgatttcttctccttttcctgttgaaaataattttcctgcttataatatgcgacaaaaaccggatttttatgttttccggcaacaaaaaaatgccaggaaaaatttcccagcattttttatatcaatacgctttttattttcagctaaattttctattctatcagccgataacatcgctcatgtcatacattccagcaccttttcctttgaggaattttgctgcttctactgcaccttttccaaatacagcttttgagtatgcagtatgcttgaactcaatcacttcgtccggaccacagaataacacttcgtgttctcctacgattgttccaccacggactgcggaaattccgagttcttttttgtctcgtttctgtcttacctgacttctgtcatagatgtattcgtactgattgtccattgcctcattgatactgtcagccagtgcaagtgctgtaccgcttggtgcatccaatttctgattgtgatgtttttctacgatttctacatcaaatcctgctgctgcaagcacttttgaagcatcctgcagtaattttaaaagcgtgttgattccgagggacatatttgcagaacgaagtactgctgtttcttttgcagcttctttagtctttgcaagctgttcttcagaaagtcctgttgtacacagtactaatggaagtttctttttcgcacaatactccaataccttatctgtcgcttttgcagatgaaaaatcaatcattgcatcggcctctacatcacatgtatcaatatctgtaaacaccggatatccattgtctctgttatctacaatatcaattcctgctacgatttctgcatctgcatctttttcaaccagaccactgattacctgtcccatgtgaccgttacagccactcataataattcttaccatctttcgttcctctttttcctgtattctcatgctactacagcaaatattaagtaatccacttattgttttgccttaattttcgctgtattacttgataatttcgagtgataccactcggtctgctgcttcttttaatttcggagttacaacatttcctgtcaaaatcatttccatctcctcatcttttgcctgtatcaggttgacgacatcatcatctgaaatgattccaaactccacagcacctaatacttcatcaagaatcagcatgtcacattcctgtgtcacaagaacttttttcgcataattcaatccgttacggatattgaagttctcttcctgacgctcttcttcggtcagatcctcataacacttgttctttttttcaaatcggaacaattttacattcggttcaagaaccgaaagataatccacctcggaagtcgctctgcctttcaaaaactggattacaatcgccgttttaccatgaccgattgctcgaattgcctgcccaattgccacacttgttttgccttttcccgggccacaatacacctggacaattcctttgttttccatatttacacctcttacagattcgatatagacctttttcctctgtttcttgcgttttccacatgctgtgtatatcttactacacctgaccaaagattgcaatccaaattcctgtccggcaaaacttctctgtttttattcattcagcaggtctgtatctccataattttctccgtactccaatttactgacagaaacttcatacgcagttcgcttttctgtctcggtttcacttaatttctttatatattccctgctctggattcttccccagatatggagacgtcctccaacttcaaatgaacgggcaaaatttgcatttcttccccaacagatacagggaatataatccgattttccataaggacggttcactgccagaagcacatccgcaatctctcttccaagcggagtcattctgtgaaccggcggcttacatatgtaaccgttcaattcaatcagattcgtctctactgaatcatcttcttcctctacaaaggtaagttctctaacaaataccgacaacaccagccggttcttcttttcttcatgtctgttataggaccgaaactgtccctgcacctgtatatattcacctaagtaactttgcgtaacatccaccagtctttctgagaccataagcggaattctgtcctccgaaccacttaagcgtttcaccaaaatgtctaccatgtaaaagccctccccatatacttcgtggctctttacaaactctgatgcaactacgcccaccattgatacctgattgttttcaataattttatctgccatgaatcactttccccttcctctttttggtattttatctttattaatctattcatgagagtggggatttattcctgtttttttatttttttttgaaaaaatttttgaaaactaaattttttctttgtatttacggctaattgtgatagaatggcttgtgattaaaaatgttttttacggtttctaatgtgccatttactattttatataggtacattctatttggaaaagaggttattatgaaaacaaaaagagaagatatcagaaatgtagcaattattgcccacgttgaccacggtaaaaccacccttgttgaccagctcttaaaacagagtggtgtattccgtgaaaaccaggaagtgcaggaacgtgtcatggactccaatgacatcgaaagagaacgtggaatcacaattctttctaaaaatactgctgtttactacaaagatacaaaaattaatattatcgataccccaggacatgcagatttcggtggcgaagtagagcgagttttaaaaatggtagacggtgttatcctgttagttgacgcctttgaaggtgcaatgcctcagacaaagttcgttttgaaaaaagcccttgaactggatttacatgttattgtctgtatcaacaaaatcgaccgtccggaagcaagaccaaacgaagttatcgatgaagtcttagaacttttaatggacttagatgcatcagacgaacagcttgactgtccatttttatatgcatctgcaaaagcaggacacgctgtacttgaccttgctgacactcctgaaaatatggaaccactctttgaaactatcttaaaatatattccggctccggaaggtgaccctgaagaaggaactcaggtactgattagtaccatcgattacaacgaatatgtcggacgtatcggtgtcggaaaagtagaaaacggaacaatccgtgtcaatcaggacgttttacttttaaaccatcatgatcctgataagaaaaaacgcgtaaaaatcagcaaactttacgaatttgacggacttggcaaaaaagaagtaacagaagccagctttggttctattgttgcaatctccggtattgcagacattcacattggtgataccttatgttctccggaaaatccggtggcaattccattccagaagatttccgagccgacaatttccatgaacttcattgtaaatgacagcccgcttgccggacaggaaggcaaattcgtcacttcccgtcatttaaaagaacgtctcttaagagaattaaatacagacgtcagcttacgtgtagaagaaacagaaagcacagactgctttaaagtttccggacgtggagaacttcatctgtctgttttaatcgaaaacatgcgtcgtgaaggctatgaatttgcagtcagcaaagcagaagttatctatcacgaagatgaacgcggtaaaaaactcgaaccaatcgaaatcgcatacattgatgttccggaagaattttccggtactgttatcaaccgtttaaatgaaagaaaaggtgaactgcagggcatgagtccggcaagtgacggaaccgtccgtctggaatatcacattccatcccgcggattaatcggtttccgtggagaatttatgacctccacaaagggtaccggtatcatcaatactgcttttgacggctatgcaccatacaaaggtgatatgaactacagaaaacagggttcattaatcgcttttgaatccggtgaagctgttacttacggactcttctccgcacaggatcgtggtactttatttatcggacctggtgaaaaagtatacagcggaatggttatcggacagagtggaaaatcagaggatattgagttaaatgtctgcaagaccaaacatctgaccaacacccgttcttcttctgccgatgatgccttaaaactgactccgccgagagtgttaagtcttgaacaggctctcgaattcattgataccgatgagctgcttgaagtcactccgaaatccctgcgtatccgtaaaaaaattctggattccagacttcgtaaacgtgacaacatgaaaaaatagtaaaatcggagcattaaatatcgaataaaactcccaaaaaagagaacatttccaaccggtaatgttctcttttttttacttttttgatacaggtcaagcggatattcgcaatccgcttcgctacttgctcataaccaaatagctgctacgcagcttatcagaaggggcttgccccctcctgatacaagcaagtccccacccctgcttattgctttttgcaattgaagcaggggacttccttgatttggttaaatttttaacatttttcagaaaatttcgattattttttaacaattcttgcaatcacttcgttactatgctaaaataatttcataaacaaatggtttttatatgcaaagcaaccaattttattttaggaggtctctgaatggcaaaaaaagtcgaatccaaagtacctgaaactatcgatagcgtagaagcactccagacaaagattgctgctatgagagaggcgcagaagaaatttgccacgtttactcaggagcaggttgataaaatcttttttgaggctgcaatggctgcaaacaaacaacgtatcccgctttccaaactggccgtggaagaaactggaatgggtgtcgttgaagacaaagtaattaagaaccattatgctgcggaatatatgtataacgcttacaaacgtgtaaaaacctgcggtgtgattgaagaagacaaatcttatggaatcaagaaaatcgctgaaccggttggtcttgtaggtgcagttattcctaccacaaacccgacttctaccgctatcttcaaatgtctgatttgtttaaaaaccagaaatgcaatcttaatcagcccgcatccgcgtgcaaaaaaatgtaccgctgaagctgcccgtatcgttttagaagcagctgtaaaagcaggtgctccggaaggaatcatcggatgtatcgaagagccgaccatcgaactttccaatgaattgatgaaagctgccgatgtcatccttgcaaccggtggtcctggaatggtaaaagccgcttattcatccggaaaaccggcaatcggtgtaggtcctggaaatactcctgttatcatggacagctcctgtgatattcctaccgctgtttactctgtcatccattccaaaacatttgataatggtatgatttgtgcttctgaacagtccgttactgcaatcgctgatatctatgatgcagtgaaaaaagaatttgtcaaacgtggatgtcatgtactgaacaaaacagaacttgaccaggttcgaggcattctcttaacagaagcaggcactgtaaatccgaaaattgtaggacagccggcatacaagattgctgctatggcaggtgttactgttcctgctgatacaaaaatcttaatcggcgaggttacatccgttgatgtttccgaaccatttgctcatgaaaaactgtcccctgtccttgctctttataaagcaaaagatttcgatactgcacttgatatgtcagaacagcttatcgcagacggtggatacggtcatacttcttctctgtatgtacatccatcagaaactgaaaaacttgccaaacatgccgctcgtatgaaaacatgccgtattctggtaaatactccgtcatcccacggtggtatcggtgacctttataactttaagcttgctccatccttaacattaggctgtggttcttatggtggcaactctgtttcagaaaacgtaggtgtcaaacatctgctcaatgttaaaacagttgccgaaaggagagagaacatgctgtggttccgtgcacctgaaaaagtttactttaagaaaggctgtctgccggtagctcttgatgaattaaagaattattatcataaaacaaaagcatttatcgtaactgatactttcttatatcagaacggtcataccagaccaatcaccgataaactcgatgaaatgggtattccttatgactgcttcttcgaagttactccggatccgactttgcagtgtgcacagagaggtttagagcagttgaaagcatttggtcctgacgttatcatcgctctcggtggtggttccgctatggactgtgcaaaaattatgtggatgatgtacgaacatccggaatgtgcatttgaagaccttgctatggacttcatggatatccgtaagagagtttacaccttcccgaagatgggtgaaaaagcaatgatggtttccatcccgacttcctccggaacaggttctgaagtaactccatttgctatcatcacagatgctacaacaggaacaaaatggccaatcgcagactatgaactgcttccagatatggcaattattgacgctgatttcatgatgagccagccaaaaggactgaccagtgcttccggtatcgatgctctgactcatgcgctcgaagcttacgtttccattatggcaactgacttcacagacggtatggcattaaaggcagctaagattatctttgattatctgccatctgcttacgataaaggagcagctgacccaattgcccgagaaaagatgggtaatgcatctaccttagccggtatggcatttgccaatgcattcctcggtgtctgccactccatggctcacaaactcggtgcttatcatcacctgccacacggtatcgcaaacgctctgttaatcgagcttgttatgcgctacaatgcagacccggcaccggttaaaatgggaaccttctcccagtatccatatccacacgcaaaagaacgctactgtgaagttgcacgttttgtaggtgtgaccggaaagaatgacgatgaagtatttgaaaacttcatcaaagcaatcgctgaattaaaagaaaaagttggaatcaagagaaccattaaagattacggtatcgaagaatctgctttcctcgctacattagacgaaatggttgaaaatgcgttcaacgaccagtgtactggcgcaaacccaagatatccacttatgtctgaaatcaaagatatgtacttaaaagcttactatggtgaataattgaatcattgttaccgcttattcacttttcgttaaatttgaattactcctttcgcgctattacctaaatagcaaaacgaccgctcacagggaaacctgtgggcggttgttttttcttgtcataataaataattgttttgattttttctttactcgacctgctgttcgccttctccgaagtaataataagcattaccactctgaagggtttttccttttgcttctgccagttcactgacagtcacaagtttaaatccttttgcaatcaaatccggtatcattcggattgccgcttttaccgaccattcatgaatgtcatgcatcaatacaacggaaccgtcctgtgcattatccataacaacctgataagtctgatcctcactcttggttgcccagtctctagtatcaatactccagataatcagcggatgatcaattgctgctttgacagaatcgttgaaagaaccacctggcggacgcattacggttgcctcaaatccagttgcagcttttaatgctgcatccgtattgcttacctgctgtgctgctgcatctgctccaattgtcaccaaatccggatgactgtaagaatgatttccaagttccattccagcatccgataattcctttgcaatttccggatatgcttctacattttgtcccagcatgaagaaggttgcttttgcattattttctaccagacaattaagcaattcttcggtatactcacccggaccatcatcaaaagtcaatgcaatcattggacgctgttttgtctcatcgtattttccatcttcatcaaaatagcagtctttgtcatcaattgtctgccatcctgtcaggatataaccatttgaattaaaataatatgtactgccatttacttcctgccagccatcctgataataactgccatcccgattctgataccaccagccgttttcatcctgatgccatccaatacttggcgctgcctttaacttatctacatcagaagcactcatgaccggctgttttcctgcctcaccggtgtcttctgctgcctgaacttctacggtactgctgtttgcattcttagcactactgttttttatatgaacaccggagaacagctttccaactcctcttcctgcaaaaaccaatacgaataccagtacaactgccattgcaccaatccgcatcatttttcttcgacgtaactgacgtatcttttcctgcttacggcgcatcattctctcatgtcgaatacgctgacgctctagttcgtctctttgttcttcgtccatttttctttatccctcatttccttttcacactcaaatcctttgttaatcataccttttttttcgacattatgcaacctctacactcttaattttcctttacaaaagtgttacaaatgaaaaaagagattagccattttctgactaacctctttctactgttttttcaagcagacattctttgacagttcgaactaattcattcatttatttattttctaatttgcctgtacttctgcgctttttactttcgctttctgttttccaaaaaacgcttttgtctctgcaaatacaaccggacttaacgcaatcagtgcaattaagtttggaaatgccatcaatgcattaaagatatctgcgatattccatactgcttctactgtcatgtaaggtccgataaaaattgcaagaatatataaccagcggtatccttttactacttttttattacggttgaataagtattcaatacatctttcaccatagtaattccatccaagaattgtggtaaatgcaaagaataccaaacataccatcaatactaaagatgcaacagccggagggaacgggagtcctttctggaatgcagctgttgtaattgccacaccttcaagaccagtattccatgtacctgttataacaatggtcagacctgtcatcgtacagattacaatagtatcaataaatgtacctgtcatagaaaccagaccctgacgtacggtagaatgggtctgtgctgctgccgctgcaatcggggcactaccaagacctgcttcatttgagaagataccacgtgcaatacccttctgcattgcaactaccatcgttcctgccgctccacctgccagtgcgcttcctgtaaatgcactctttacgattgtgacaattgctgccggaagtgctgtaatatgtgtaataatgacaataaaagcaaatacgaaatagatgattgccataaatggcacaacaacctgtgaaacacttgcaattctctttaatccaccgataacaaccagcccaacacatactgtcagagccagacctgcaatgattgttgcgatagagtaatctctgccaaataatgcgatagtgtttactttatccgggtcaaagaaattacagactgctgaggaaattccgtttacctgtgtgaatgtaccgattcccagtaaacctacacccgcaccaaagaatgcaaacatttttgcaagccatttccattttacacccataccattttcgatatagtagaatggtccgccaagtacatgaccttctttatcgatagtacgatatttgattgccagcacaccttcggaatatttggttgccattccaaaaaatgctgcaacaaccatccagaataatgatcccggaccacctgctgcaagtgcggttgcaacaccgacgatatttccggtaccgattgttgctgacattgcagtacaaagtgcaccaaaactgctgacttcaccttttccgccctcttcattttttaccataaatttcagggctttgcccaggtgccggatttgaagaaatcccatgctgacagataaataaatacctgtacataagatgagaataatcagcggtaatccccataccgctccgtcaatccagctgattacattgttcattgtttcaaacatttcttttacgtcctctctttcttttcgatgcaccactttggtacatttcctagaacctctcttgaatttttcagttcagaaaacaaaaaaactgtggaatcctcattccacagtctcataagagtacgacaaaacatatacaagataacctctgtatactctgtccttttgcctgagagattaacaacataaatgttgccgtacaccttcggcgctcttacttgagactctccagagtgttgtctttcgacaacgtttactatagcatattcccgtgctgaatacaagtgtttttttatgagagacatttttctaaaatctgctcaaactacagttcctgtttcttgacattttattcgcacaaattgcatagtcattcccgatttcctgtgctattatcaaagcatcatcacttactttataatttattaatttttcatgtaaaggagcattaatcatgttaaaaaatacgtttaaaaatccacttctttccggattttatccagacccgtctatctgtcgtgtaggcgaagactattatcttgttacttcttcttttgtttattatccaggacttccgattttccacagccgtgacctggtacactgggaacaaatcggccatgcaatccatcgtccggaccaattagattataaaaattgtgagacctctttaggattatgggcaccaagcatccgttaccacgaaggtacattctatattatcaatacttttgtgtccgagggcagagaagccagacgcgataactacattgtaaccgcaaaagacccggctggtccatggagtgacccggtatttgtagagggtgcagacggaatcgattccagtctgtttttcgatgaagacggaagcctctggtatgtgggaaactttatcagtgaagaatgtcgttatgagggacaccacggaatctatctaaatgaattagataccgaaactttccagtttaaaggcccacgctacattatctgggatggtttcaaaaccagaagtaaatggattgaagctccacatatttataaaaaagacggctggtattatctgctggttgcagaagggggcacatttgtaaaccacagtgtacagatggctcgctgccgtaccatcaatggtgactatgaaatctgtccgagaaatccaattattactcaccgtcatcttccgatcgaaaatccgatttctgttaccggacatgctgatattgtggaaactcagaatggagaatggtggatggtacttcttgccgttcgtccttatgtcggaggtcattacaatctcggacgtgaaaccttcatggttccatttgtatgggccaaagatggctggccgatgattgacaatgaaaccggaatggttcagaccgaagaacgacttccaaatcttccaagaaccattctgcctctgattccgactaccgataattttgaaagcgaaacccttgcaatgcagtggaataccattcatccgccggtagaaccattttattctctgacagaacgtcctggatttctacgtctttccacccgcccggaagtgcttgaagaaatctgtactccatcttttgttggacgacgccagcagcataaaacatttttagcccgcactgccatggaatttattccacagacagaatcggaagaagccggtgttgcgattcttcaagatgaccgctttaattacattatggttctaaaagaaaaagacgatgaacttgtgctcgagcttcacaaaacagaaaatggaacaagaagtctcattacctctgctcctgtaaaaagaagtaaacgtctgtatctttctattcagggaaatgtaaccgactacagcttctattatggatatgacgaacaggaaatgactttacttgcttcaggtcttgatgcttctcttttaagctctgttgtaaacgaaggatttaccggtgcttatatgggtatgtatacaagctcgaatcataccgaaagctttaaccatgctgactttgactggttttcttatcagggtgaataattttaatttttgcctctgcaagtaaaacatacaaaaaatggcccacagaaaaaactctgtgagccatttttttatttaaacgcttctgctatctgttgtaccagagcgtttacatctgcattttttaccagatatcgttccgttccattgactgcaacactgtcataatttccatcataagtataatacgtcagtgtaatttccggtgcttcttttgtacttctgtggaataccatacgcagcacttcttctttttcattatccgccttcggagtatctaaattagaatccagcatcacattcaacaatgcctgatatagggttgtaaaggtttctttttccacttctttatcgcccatataatattttccatctttgattttcattgtataagaagattcttttgtcttgatgtcaatactttctacggtatcaatatttacaagtgccggaatttttaagatataatcaaacggatttaagttgtaaattgcttcaagtgtactggtaggaattgtatacacttcattttcatagcctgctactgccacataacgatttccaaggtcatcttcatttccaagcagtaaggtaaccgtcttatctgcttcggcagaggtatcagtactctctgtataatcaatctgcatcgttgttgtacttcccgctacaccagtatctgttccatccggaacttccgcagttgttgaaaaatcaaatccgcttaacacatcaaacaatttatacatggtttccgtatttacagtcgctgtctcatcgtaaggatttaaaatctcccagtaatcaaactccatcttgtaatcggccggttcttttgacaaagagaaaatttcttctccatctcggttaagtacgagtttacggattccatcagaagtaaaagtcgggtgttctgtcttttcaagttctactttcttttcctctgtcttttcctctgtcttctcttcggtttccgttttttcctcatctgcagcttcttcggttttttcttccgcttcgccattcgtatcttctgtattttctacttctttcgtgccttctttttctgttttatcttcgctttcttctgcttttgtctctgttttcgtttcctttgtttccgttgtctgcttctgacatcctccaagtgtaaacatacttaatgatgctataattcctaacaacgcaattttttgcaatatttttcgcatattctttttgtccatcctttcttacccttttctattctgttactttttctttaatttctctaaaaaggggaatctcttcggattcccctctatactagcacgttctcttttaaatggcaaaatcaatttttaccgatttgcatctcccttaaaatctaattaactatttctgtcacttcacaggcttcttctcttcccgccagtaccagatttttagaaaaagcctctctgatatcatggcagaatccaccaactctattgacacacccctctctaaatggtacgattttcacaaataatcacaaaatttttagagatgtaggtgaaaaatatggactatcaaacacaaatacaaagctttacagatgagcagcttgcaactcttatcgacgatgaaactgctacagaaacacttggattagaagctgataaaatacgtcgggaaaactatggaaacgaagtctatgtacgtggtttaattgaattttcaaattattgtaaaaatgactgctactactgcggtatccgaaaaggaaaccggaaagcagaccgctaccgcctttcttttgacgacattttatcctgctgtgaagaaggatttgctctcggtttccgtacctttgtactgcaaggtggagaagacccgtggtacacggatgagaaagtctgtcagattgtttctgctattaaagaacgctttccggaatgtgccgtcacgttatcgattggagaaaaatcaaaagaaagctatcaggcttatttcaatgccggtgcagaacgctatctgcttcgccatgagacagccgagcctgaacattatcagaaattacaccctgacagcatgagccttgaaaaccgcaaacgctgtctctttgatttaaaagaaatcggatatcaagtcggttccggattcatggtcggctctccttatcaaactgccgaaaatctcgtttcggatcttcgatttttgcaggaattacagcctgatatgataggaatcggaccttatattacccatcaggataccccgtttgctgaatttccaagcggaagcctgactaagaccctgcgtctggtttcgattttaagactgctctttccttatgcactgattccatccaccacggcacttggaacaattcatccggaaggacgagaactcggcttaaaagccggaggcaatgtcgtcatgccaaatctttctcctgtctcggttcgtaaaaaatacgaactctatgaaaataagatttgcaccggagaagaagctgcacagtgccgaggatgccttgaagcaagggtaaaaaaagcggggtatcagattgtaacggcaagaggtgatgtaaaaaaacattaaacataagggacggagttcgtggcaaacgccataaattccgtcccttatttcttactgcagtgcctgaagcatctgaagcattgtcatttttgtaattggatgacgtttccacggtgcaatttctgccattggaattaatacaaaatcacgtaaatgcatttcaatatgtggaatatgtaaatccggtgcatcgattacttcgtcatcatagagtaaaatatctaaatccaaagtacgaggtccccagtggatgattcgttctcggttagcatccgcttcgatttcatgaagcagatcaagcagttcataaggtggcagcagagttttaagttccaatgctccatttaaaaaatcatcctgttccactccgccataaggttcggttacaagataatcagaaacctgaacaacactgcagtcctctgctgcatcaagcaaggcaaccgcacggtcaagatatgcttttttatcacccatattagagccaagagcaatataggcagtatgccagcttctgctgatttcgactgaaacggtatcaagtggaagattgattggtgcccatggtttttttactgtaatatctacctgcttcacaagagtagaataagtgactaagattgtatgagcaacttcttctgcgattttttcaattaaattccaagtatttccctctacgattttttttatcagatgggacacttccccatagttaatcgaattttcaaggttatcggttaagcctgccatgcgggtgtctgtgtgaagaactgctgaaatcacaaatttctgtcccagaaaattttcctgctcatacacaccgtggttggcaaatacttctaaatctttgacagttatcttatccataataagttctccgattcgttattagtgagcaagaattgcttttgtcatctggatgatacgtttgttttctttgatatcatgcacacggacaaatgcacagtttttcatcacaccgattacagttgtggcaagtgttccttctacacgctggtcagccggcagattcaacgtatttccgattacagattttctggaagttccaagtaaaattgggaaaccaagtctgtgcagaacgtctacatgattgattgcagcgaggttcatttcataagtttttccaaatccaacacctgggtctaacatgattttatcatcagcaactccggcttctcttgcgattttaacacattcagccatctcacttaccatgtcttctaagaaatcattgtaaactgcttcatctttgttatgcatcagacagcaggctgcattatattttgcggtcataagtgccgtttttttatcaaatttaaagccccatatatcatttacaaggtctgcgcctgcctgaagagcagcttctgcaacatttcctttataagtatcgattgataccggaacatcaaaacgagctttgacagcttcaataatcgggacaactcttgcgatttcttcttcttctgaaattacgatatgtcccgggcgtgtggactctccaccgatatctacgatatctgtccctcctttaatcatttcttctgcatgatgcagagctgcatcaagattattaaattttcctccgtctgagaaagagtccggagttacatttaaaatccccataatataggtttcattttttacatcaaattcacgatttccgattttcatagtcttttatctccaaatttagtatttaacaaattcgttctaataaaacaacgctaaatttttcttggtatccggccagttacattctttgattgccggacatgcaaaacagttccgagactgtttgtctgcacggtaaagatattttgcaagaagagaatcctcctcagaagattcttttctgtgaccggcgatggcttctgcaacctgtataacttcttctttagagaaatcacagaaagtcataatttcatccgctatcctcgcaccggaaatatggtgtggagtaccaagtgaaatctgttcatagcgtccgatatcatgcagcagggctgccgcatagatcagttctttacttacgtttgttttttcttctaaggtatagatgtacatcagtcttgcaacatcaacaaaatgttccattgtatgacggcagaactcacgatctttttctgcatcctgtaataatttaaactgttcctgatacaatggatgatttaaaattttctggattcgttccataaatgaatcaaccttttaccatctggaagaaagtctgctgaaggttaaagtcttctgcaaaagcaccgcgaaccatagttgttacggttttgcttcccggtttctgaactccacgcatggtcatgcacatgtgctctgcttcaatcataaccataactccctttggctgaaggtgttcttctaatgcatctgcaatctgtgcagtcatattttcctgaatctgtggacgtcttgcaaatacttcaacggtacgggcaagtttgctaagaccagctactttttcatttggaatgtaagcaacgtgtgcttttccgtagaatggaagtaagtgatgttcacaggtagaatagaacgtaatatctttttctactaccatattgttgttggttgcatggaactgtttttcaagatgtacacctgcatcttcataaagtccgccgtaaatctgttcacacatgcgggcaatacggtccggtgtctctaaaagtccttctctgtttacatcctctccaataccttctaataacaggcgaacgccctgtttgattttctcatggtccatcatttctaaaaatcctcctctaatataaatgaataatgtttcgggatgtaagacaagaaaagtttaaaagacacaaaaaaaacatcccgatgtgaataagtcatctggaataaataataatttttatatcccttcacaatcgagatgttgctgtcatctgtgtgttgcaacgggtgcggactccatatcgtaagacgagcttttcgtttctgcggcaactccccatccactgaacacttaacgcatagaatcctattttgcatattatttatctgcggctattatagcatcgagtacagaagaaagcaatagaaatccgtagtttgcaggggggttttggaaggtttttcctgtttatgtaaaattcaaaagaagggaatgtaaaacaatgagacaaagaatctgaaaattaaataaataagtagaaatagccgctaaactgttggtatgatataatattaatgatataatattaatatagaaatctaagaaaactatttgcgtattcatttttttaattctttcaaggaaaggggaaaatgtaatgaaaaaacagaacaaatcctctattgtatggtttattcttagcgttattgcaatgattttcttgacaatgcgagttgcgatgaactgggaattgaagggtgcagtattggtgttttttatttttggtatcgtaatagaaattatctggatagcaaaaaatataataaaattttttcgagaatatgaataaaaagcctcctgattttagagtcccaaaaataaatgggccatcctcaaactagattagcccatttattttttatttttctcgatttgccaattcttctgcaatctgtggcatttcacggtctaatttataaatcaccagcataattgctgcaatcacccaaatgatgaccggtccccatttatagatatcagcaatcattgaaatcgcacttcctggctgtactacatctgttccctgtgaactgatgtatccacttgcagtcattaaagaagtaatcactgcacttgcaattcctgaacctactttaaatccaagacttgcgcctccaaaaatcatgctttcctgacggaaaccatttttccagtaactatactctaccacatctcccagcataccaaatactgtcgcatttagctgtgctacaccggctgaacgaatcaatgtaatcgcaaacatatagtagaagttgtttggatttagcataagacatacctgcgctgcaatcgcaactactgcaccggcgagtgtaatatttcttttcccccatttcttgataaacacaggacaaaccatcgcacccaaaataattacaatcgtctctgcaaaatataatacactgtacatccatgaatcattatggaagatatatttacaataatatggaaggcttgtaccaataattgtcatgtgagtaacctgaactgtccacaataccagtacacaccagaaatatttatttttaaccaatgcttttaagtgagtcaataccgggattttttctactgtttttttctgctctgttgttatagtttcttcacattttaagaagcagaataagagtaatgccatagcaatgacaacccataatcccattgttttaatccatgcagcctgatcatttccaaataattttacgattggcattgtaaaagttacagaaataattcttccaaacggagaaataatcattctgaaaattgataataaatcctgctgataagaatctcttgtcattaatgcagataatgcgccataaggtacattaattgtgtcttataattaatttctcctgttcccggctcatgacgtcccggtgcatctgcaacgtgaatatgaccaaactgatctccataatttgtaatggtgtcgcaaatacagctttcattaatctgcatatgataaatatcataaagtacttttaatcttggtgaaccgatcagacgacaaatttctgctgccatctgtgagcacttggacttgaaaaagaaatcaaagtaatctgccatgacgttgctgctaacacaaaacttttattagaagatggaagtattgatttcacaattactcaaaatctttatcgtcagggttacctgccgattatttacttaaaagaatatttaaaaaatgatacccttccagattctacgaatattacacctcatatttctattatctgttcgcaaaatatttaactcagattcaacacttgtaagactcatcgcatgattacaaagaaaaaagccatcttttttaatttttttaagatggcttttttctttttcacaaatttttcacatttttcctattttattttttatttgtagtgttataatacagatagtgcatatagaacttctgttatcacatcttctatacctacacgaataattattttgatttttcaggaggaatagatattatgactacattaaaaaccacaaaaagaaatccggaagtaaaagcaaaaaaattaagacgtgacggttttgccacaggtgttctttacggaagagaaatggacgaaaacattccgcttcagtttagtgcggtagacgccagccgctttatcaaatcacataaagaaggttctcaggttatccttgatttcggagataccaagacaagcgctatcgttaaaaatattgattacgatgcaatgaaacgtcaggtaatggctctggactttcaggcactggttgccggggaagcaatttctacgactgttccggtaaaactggaaaatgaaggcgctgttcagggatttgttgaccaggaactgactgaaattcattacaaagcagaccctgcacatctgcttgagcctattgaaattgaccttaccaaattccacacaggcgatgctctgtatgtaaaagatttgggtctggaagaaaaaggtgctcagcttatcacaccggctgattccttaattttccacattgcagaccatgctaaaaacatggaaattgctgaagatgaaacagctgacgaagaagctgctgaagcctaagtagtaaaatgaataaaggacggagtttatggcgtctgccacaaactccgtcctttattcatttttttattaaatctccaccttttctaccctccacttcccatctttcagatataaaagagccatcgacggtgcatcgaaaaatcttttttccccacaactgcctggattaagccaaagccttccctctttttctctttcttcatatttatgagtgtgaccgtaaatcacaatctgcgtttcttctaaattccaaggcacatcttttttctcatgtaccacacagaaattgactccgtccagtgtaaaacgctgacattttaataagtgtgacgcccatgcgccatcattatttccacgtataaaatagacgggtactcttggctttaaatgtataaaaatctcatctataattctctgagaaccgatatctcctgcatgaatcagcgcatcacagctttcaatttgttcaagcacttccggtcgtaacaatccatgcatatccgatagcactgctattttcatctaattactccttttctgttttctttttattttaccataataaaaaagccatggactaatattttgtccacagcatttttattttttctgctatctgttgtaatttctgtccacgatatccaaaaatcctcactgctaaatctccactgcaaagctttgtcacaccgccgtcacattctgattccatttcaaggatttcccagattctttctgtaatttcagacatcacttttccgtcctcaagttcggataaaaacaggtttgccacatgcgtatacccttcatacagaccaattttttccatcggcattttttctggttcatatctggtattgtcccggtaaatcatttttccacttcggtaaatcgtcacttttgaagcaaactttcggtataaaaagcgttcttcatgtgccgttcttccacaggaaatcacatccagaaaaaagagttttgcactcttatcttccagttgaatctccatcgtactctcgaaagcagaatctgcaaatggaatcaccggctgaggataataatataacaccgaatctttttcgacgtttactttgatatttcttttcgcctcaccgccatccattttatggattttttcaaatgactgcgacagtacttccaagtctgccccctgtcgtacctgataggaaaattcctgcaaatcaccgctcataattccggcggatgcacaaagaggcatgacctgaatcccgccattttctttctcaaatggtgtcataatcttatacggggcggtaaaggatacatcctctaaaatggtttttccgtctttttttcctgcacagattgagacacgggatacttttccgaatttattttccattctacatgccctctaagaatacgtttttcttaatccactctaccacaatatccacattttcatccccacggatgttggtaaacacaaaaggacgctctcctctcatttttttagagtctctgtccattacctcaagacttgctccaacataaggtgctaaatcaattttgttgattaccagcaaatcagaacgggtaattcctggaccgccttttctcggaattttatcgccttctgccacatcaatgacaaaaatcgtcgcatcgaccagctccggactaaaggttgcagacaaattatctccaccactttcaataaataaaagttcaatatccggaaaacgctctaccatctcatccactgcctctaagttcatcgaagcatcttcacgaattgctgtatgtggacatccgcctgtttccacacccgtaattctctctacaggaagcacactgttcttcgccagaaactgtgcatcttctttggtataaatatcatttgtgataacagcaatgctatattcttttgccattttccttgataaggcttcaatcaatgctgtttttcctgaaccaaccggtcctgctactccaatttttacataagacatattgctttcctcactttttagctcacatttactttttacgacatatataatctggaatacagtttttcatgctgaattccacggatatcaaaccccggcgcagacagacaaagctcctctttggtctgtgtttttaatgtttcaagcacttcctgaaattcaaaaaagcatctgcttaacaacttttgccctacactttgacttaacggaatcgtctttacacagtttgtcaccattgcagaggtctgcgcataaagataatgttctaatgcttcttctaactcaattccaagcgccgaacaaaacactccataaacacagctgtgactgatattttttccttttcttgctgtcacatactctttataaattcctgtttcattaatttccaaatccagtttttcaatcgtctttacaaaccgagagcccatttttctgactgcatctctttgttccatcggaattctggatgcctctaaaatttcttctaattcttccagttcttcaagacgttctgcctctgctgactcataggccagctttaccgaaagcagttctgttgtagcaaaattccatttaattttatttttaatatactcttctgctgttttttcatcatgtacaattccattttgtatataagcttccaatccctgtgaatgagaatacgcaccaattggaaataaagcatcatttacctgaagcagataaaattttttctgtgacatgtaaacgtctccttttaatgatgatgattatgaatggaagcagaaatccgtttatcaaaatccaatttcatcacttctttttctgcttttacaccatgaattttttcaagcatcacaagcattggctcattataaatcgtaataaatgtatcattttcaccccaaaaaagcggtgcatgacggtttccaatttcgtaacataccttcgcagacatcttctcatgtcccggtatcaaagtcacacgaatcacttcacatggaggggtattgactaccactaattttttatcatctgcatagatgacatcgtcctgataaagaccgcgggaaagaatggaatcatccattcttatcccaacttctgtgcctttatctgtatttttcttatgaattcttttaaatgcttcatgccattcaatatcaactgtttcgatttcttttccggttgtatcaaactcattaagctttccaagtacctgttcgcacagcatattttttcctcactctctaccaaacctgtaacagcatcataacccctggaatccaggcagttaccacaccttcaaagacctgcaggcaaggtacaaattttccaagtttctttcccataatgtcctctacaaaagcagttccccacagaattgcccataagtaccagatagcagcccagcggatatctgcagtaattccaagtgcactgcttcctgtgataccctcgattgtaccaaatactacggcattgactgctacaaatgtagaaaaccaggcaaacggaatcggacttaattttaaaattttactaaatgctacaaataaataagtaaagcagaataacagtccagttcctgctgcataataatttcccataacgagattgacaaaattaataaataaagacaatccaccggtcaaaatattcatgaccgctgtagattttccatccactttatataaggcgcacattccgttattaattaatacaatccctacaaataaaagacaaactcccagcataagctccctcctgagtattattttatttatgtcaattgaacgtaaaacttgaatttagaacaagctgtacagctgtgtaagcggcagtctttcagctggttttgaagtaatttcctcgccgtctaccgtcactttataagtctcagggtctacggtaagttccggtgttctgtcattatataccatatcttttttaccgatggtacgacaaccttttaccggaacaactatcttttcaagaccgtatttttcttttacattttcatccattgctgcctgtgaaacaaaggttaagcatgcttcattttttgcttttccatgagcagcaaacattggctgatactgtaccggctgagtggtcggaatggatgcatttgcatctcccatcttagatgccacaatcataccgcctttgataatcatatccggttttgctccaaaaaatgccggattccaaagtacaaggtcagcaaactttccttcttcaacagaacctacatactgtgcgattccgtgtgtcagagccgggttaatagtatatttggagatataacgttttacacggaagttatcattttcatgaccttcatcttctggcaatgcgcctctttcatctttcattttgcttgcagtctgccaggtacgggtaatgacttcaccgacacgtcccattgcctgtgaatcagaactcatcatgctgaaaattcccatatcatgaagcacatcttctgctgcaatggtctccggacgaattctggaatctgcaaatgctacatcttccggaatctttttatccagatggtggcataccataagcatatccaaatgctcatctaacgtatttacagtataaggcatcgtcgggtttgttgaggatggcagtacgtttggtgctgctgccgcacggatgatatccggtgcatgtccaccgccggcgccttctgtatgataagtatgaatcgttcttccaccgattgctgcaagggtatcttcaacacatccgccctcatttaaggtatcggtatgaatggctacctgtacatcgtattcatctgcaacatttaagcagtgattgataaccgccggtgttgcaccccagtcctcatggatttttaatcccattgctcctgcttttacctgttcaatcaaaggcgcttcatcggagcagtttccttttccaagaaatccaagattcatcggatattcttcggctgcctttaacatcattcttaaattccatggtccgggagtacaagttgtcgcatttgttccatctgccggacctgttccaccaccaatcatggttgtgactccactgtaaagcgcacagtcaatctgctgaggactgatgaaatgaatatgggtatcaattccacctgctgtgacaatcatgccttcgcttgcaagtgcttctgtggatgcaccgactgtcattcccggtgtcacaccatccataatatccggatttccggcttttccgattcccttaattttgccatctttaattccgatatctgcctttacgattcctgtagaatccacgattaatgcatttgtaataaccaggtctaagtctccatctttactacaggtttttacagactgtcccataccatcacgaatggtttttccaccaccgaatttgacttcatccccataagtggtatagtctttttctacttcaattacaagactggtatctgccagacgaaccttgtctccgacagttggtccgtacattgctgcatatttacttccggaaatttttacactcatcttcgtacctccttacagaaatccttttaattttgctgtttccatcgatgtcgctttggtatcttcacctgtctgggcacgggttaaatcatttaacccaaagacacgttttcttccacccatctcggttaactgtacctctttttcttcacctggctcaaaacgaaccgaagtaccggatgcaatatccagatgatatccataagccttttctctgtcaaaagacagacatttatttacttcaaaaaaatgataatgagaacctacctgaaccggtctgtctcctttatttgcaacaagaatggttactgtttttttgccttcatttaatgtaatatccctttctgccggaataatttcaccaattttcatctgattgcctcctttactgaatcgggttatgtactgttacaagtttggttccatccggaaaggttgcttcgacctgaacttctccaatcatatctgctacaccttccattacgtcatcctttgtcagtatttttgtgccaagctgcatcagttctaccaccgtttttccatctctggcaagttctaaaagttctgaactgatgtaggcaagtgcctctacataattcaatttcagtcctctttcttttctctctttcgcaagatttcctgccatgtgaagcattaatttttcctgctcttttggattaagcctcataacatttcctcctcttaaaggttctaaaagtcagtttttaagtctgcaggtttttgaaatttcaatcgagcgtaaacaaaaaaagcagacaaacagcaccttacttcaagacgccattgtctgcttttaaaatcccttattcttttcaaaaactctacccgcattatacacgaactactttttttcgtcaatcattttcttctctaattcgataaagtttacaatttattcagattttgcgaaactcattttcactataccatactctgtccttttcattaatatccagcgcatacaatttttcatcttctatttcaattacgattgtatgctggttttcatcctctaaccacaccttatccattgccggttttccctccggacgcccctcacagccaaaatccggttcatcaatcctctttacgaaatattccattttttcttcctcttttcctgttttttgtattatttaaataaaaattatagcaggtgtttctggtaaaatccattctatgtttctgctaaaatccattccgagtcttgttttactctttcacttgtcttataatcgaaaccgaatctaatgaaaagaggaaatttttatggttaccctacttcttaccgaacagctcactgtgctatttctcatgatgggctgtggttttgttcttgtaaaaacaaaaattgtaaaatcaagagacagcaaaaccctgtcccttatcagtgtctatctgattatgccttgcgttattataaatgcattccagattgactattcaaaagaaattcaagatggatttttactggcactttttgccgctgttatccttcatcttctattgtttcttatctgcggaatccttggaaaatttttaaatttaacttccgtagaaaaagcatctttgatttattccaatgccggaaatctgattattccgcttgttacttccgttctcggaagcgaatgggtcatctattcaagtggatttatgtgtgttcagaccttgcttttgtggacacatgcacagtccattatgcagggaaaaacagaatttaactggaaaaagattttgcagaatgtaaacttaattgccattgtagtcggaatcattctcttctttttccacatcaaacttcctgttattctatccgacaccattaactcccttgcttctttaatcggaccggtcagcatgattatgcttggaatgttactcacagaagtagactggaaagcactgtttacttccagacggatctacttaatgacagcattaaaaatgcttgttctgccacttattatggtcggctgtatgcggattcttgcgcatcactgctccctcgcaaatgcatctacaatactgttaatcagcctgcttgcaacgatcactccgtctgcgacaaccattacacaaatggcacagatttatgataatcatccggattatgcaagtgcaattaatgtatttacaacagttgtctgcattatcacaatgccaatcatggtattattatatacactttaacgcaaacacccctgtattctgttttttcacaaaatacaggggtgttctatcttcataattcacttttaaaatggtcttggagagccacaatactcacagaatcttccggtattttccgcaccacactgacatctccaggtaccacctgactgctgcatattattcatgtctcgctgcatgccctggttcattccctgattcatgccttgattcatgccctgattcataccataattcatatcttgctgcattccttggttcattccccggttcatcccctgattcatgccataattcatgtcctgctgcatgccttgattcattccccgattcatgccctgattcataccataattcatgtcttgctgcatgccctggttcataccataattcacaccttgattcatgccataactcattccttgattcatgccttggttcataggcattccactctgcattctcggtgcctgtccggtcagcgccgctataatttcatttccgacacgttccatctccatcatctctgctcgattttcctgctcaattgcaaaactgtgtaactgaaaatccatatcatcaaaccatggagatctcacctgaatcttcatactgtaataatactcgtatttataaaccggtggctgataactgactgtctttccatctttcgtatatgtctcttcgatccgatcctgttttacatccatattacactgaaccacatctgacagtgacagaatatccggattttcttttgtatccaggttatgcgcaatggtaaaatttccctgcgtttcatcaagaaataccgtgtacttttttgttgtgatccgtcgtgtgatacggaaattctgtactttttccttatttgcttcacggtattctaattgttgtttaatatcctctacggtactatgtctgcgttcctcaaaccatggagacagcttcttcgcacattccttacatagatttccatcatctagtttgcgatttccaagcaatccgattttttctccacagatatcacaatatttcttatcgaataatcccatcttattcctcccgtctcttacatactttcagcatcctactcttcccctgcactttttacacatttgaaggtcagataatcatcttcatcactgtattgaacagacagtgacccatcctcttccattgtgataagtacattctccggtgcctcatcatccatttcgattgcataatatccataaagtgcagaccacggataagtgcctaactctgcgcctttataaatcacctgtactgtgcgatcttttgcgaaattcaaacgcattgcatcattaatattatctacaccgtccagtgtcgtctgtgcttcctcgtcaagcaactcttttacattttctgaataccattcaccaatcactgccaattcatcttctgacagataattttccggatttgttgcatctgtcccttctcttccgaagataatatttactccctgtcccagcagatcatcaagaataagggtatctccatcaagggtaactgacatttcctccccttcaatttttaaaacggttttttcatctttctttgccagttttccggtgcctttgtcattgtcaatcgtaaattttacttttccgctgtgctctatttcgagatttacatccccctcaaaacactcttcaattggcatctgcgttccaagcgcttctgctacaaccgcaatccatttcccctcatatggattctttttcgcagcttttccacctcctccacatccgattaaggataacgtacttacaaccagaatcacgctcagcaaatatcttatactcttcttcatctctttttcctcctttgcataatgtgattttctcttatattcacattatacaagggaaacactatttgttcactgttacttctgatagtaatttaaaaattatctgatttttattaaaaatatcattttaatgtcgtaacaatcaacttactttccaatgctgcggcaatcaaatcttctttgcagctataaccggcttttgaaatcatttcctgaaaattccaccttacgcctgcccttgaacaattcatcttttgagcaatctctgcataagaaaatccacaaatatacaatctcagcatctctagctgccttgggctaatttccccgctcgtaatccagtttaactccacactcggcgtaacatccggaaaaacatgttctccttttacagtgcgccaaatcacatcccgaatttcttcctctccatgatctttataccaaaggctgtccgcacacccacttttggcacgctccagcaccttcggatcaataagagaagtcacaatcaaaatctttgtatacggacatgcctctttgattgcttttcctgcttttaatccatcatgattatgaaaggtctggacatccatcaatacaatatcaatcgcggaataagtacaaattttcactgcttcctctgcatctgcaaccgtatcaacatgtcgaaattccggatcctgcaaaaggatatactcaaagtatcgttgcataatcttttgatcttctacaattagtacacgcaccataatttttcccctctttcaatcctgtctccactgcttactttgtctttggcatctttataagtaaacaaaactctggctcaaacacggtaaacatcctgcatccttctatctccaatgctctgcgaagcgcggataatcctccaccttctcttgcacctttttttggaaccattccatcgtttgtaagcttaagcagatattccctccaatcttcttctatcttcacatttactctttttccatgtgcatgcttcgcacaatttgtcacgcactcacgaattgcacggtcaagcaaaattcggtatgttgaattttccggaacatcgccttccagacaaatggtaatcccaagttctttggcatgcttttctgtatcctgatataagtcctctaaattttcaactgtcatacttgtaagaatatacacttgttgccttaacaaatccaattgtttattaatagaaagggtatcttctgtattttctttattttccagaattcttcgtattgtaagcaagctgcgcccaaaattatcatgcacctgcattttcattgccaatgtttcctgtttgcgtattctctcgccaatcttttcatacatttcttctaattgctgattcagcgtttccaatttttcattattaaacttaattctctcgctattataataaatttcggaaacatcaagcgcaattgcctgtctatatccagccagttccctgtccttaagctgatactcctgaaacatccagactttcccatccggaaaagcaaatacactgccatcagaactcatcgaaatgatctcttctctgaggttaccttccgaaatagcctgatgcagcatcttataattctgtaattttgttccaagcagcattttgcttacttctctcatcttggaattacaaagaataatctgatcaaatgcattcgcaaaacatacgccgcatggcgcattgtctactgcttcttttactgaccatggtgacaacctctgtttttctcgtcttatctccttgaaaatgctccgcaccagataaaaagtcaatcctgcaattccgcataacattaccacaatcggaacattcaaaagaagcgattgctccagcgcttttgcatcgtatttctgtacacattgcaataaaaccgttcccaaaaaagtaaccccaaaaagcacggttactgtaatttttcttcttaaatgagcagaaccggtcattcttaaaagtataagaataaactcaagcaccagacaaaattccataacactcattattaaattttgtatttctacactgcactctataaaattcgacatcgaatcagccactctttctcgtcttcttgttctacttctgcaccatgttgcccggaaagcaatgcataaatgtcattttctgaaataatatttaccgagataatcaaatgtgcctccatctcaacgacacgaaaaaagatcatttgcattcgatcaaacagttgctctaccagccactcaaaataatcataacatttaattaattcttcatcatggaattccagattttgaatattcacataataaagtgcccggatcttgcacaactttaatgccatacacgattctgccagactctgtatcaaatcctctgttttcagtgcttccctattttcattcttttcattatgaagcgttaacgtaagattttttcgcctttttaaataggttccgacaaccacaatcttccccagaagtcgttcatatacttctttcgactcggttttttccagttcttccataaagtgtgaaatcagttcaatctgaccggccgtctggctttgtatcaaatctaagagccgattttgttcttccacttttctccgctttgcctcctgctgatagttcttttgcaaaaggcgatttcgctctcttaattcttcttgctgttcttcaatatcctgatactggtccataagcaaggaaacatcctctgcccaaaataaatgaccacctcgcactaacaaatgattcattcgtgttccattttctatcacaagggtgccaactaaaagtgtttctcttacttcctgtggtatgtccaaaaactttcctgaatgataacatttcttaaagctccaatcagtaatctctgcatctaatccgcccgcagcttgaaacaactcaatatacctgctgttaattggaatcagtccacagataatagaactctgataaattgcggccatcaaaaaacaacatactgcggtcatatctcccacatatgctttaataaatggcatccccagaatatgacaaagattccagccaagcaataaaagtcccggaagcaccggaaaccaggtccactttcttccggaagcggcactcttacgcatcaacaccacttccattatcatcagacacagcatcatccaaatctgaatcaaaataaaaataaagcgatattcatagacctcattggaaaagaaaaatcctttcggaaaataaaacactttttgatgcaagtcatttgtcaatactgcaaaaatcaaacatagtgccggtattattaaacatgcactttggttttttgtattttctccttcttctttatccattaataatgccgcattaagcccgagtgtcggaatcaaaatcataggaatataataaagataccagcagatgcgcatctctaacggttccatgaaaataagaaacttaatcgttcttactaaaaaccaaaaaaccataagacaagcaatccacgtcaaacattgacgcattttcgcatccaccacatgtttctccaaatagatgacccaggcacaatataaaccgatataaatgctacttcgacactgaccggcaaactgaatcaaaaataagcttttaaatgagatctgccgacatatgtaagccaatataacaaggctcgcaattgcgatataggataacagcctttttttcttataagacatctaagacatcactcattcctttcttcatctgaaagcaatttcatatccaatcgtattatctttattgtatcatattcgttttccaaaatcgaatcccaactgtcgctgaacacaaagcgtaaatatgacacaactcaaaagcattaagtattgaaattttttttcatccatcatcccactcttctatactaaaagaataaaaaaaaagtaaacttttgtcactatcgtaagggctagtgtggacgctttgaagtcatgtgataatataattgaggtgattttatcatccgcaaaaaaattccaaaaaaattgaggtgatttttatgatttcttcctggtcagatgcaattggtctttccttcgcctggtcctttggatggggacttgtacttacctgctatgttctggattggaaaatcgaatggatgcagccaaaactttggtttctttttctaaaaaggaaactaaataagacagaagatttctttttgaatgcttctgcaattccaccaaaagtactaggcgcatttaagaaggttctctcgattttagaaaccggagactttcaaaattcatctgcaagtatcggacaatcttaccgaaaaaagctggagcatgaacttacattgttgaaaaaaaatgaaatcaagcatgaaattcgcatgactcatttaaaactgacagaggaaaatgaaaagaaacaagattttcgtcattggagcgacgctggacgtgaatggcgcgaaatcgtacttcagggcacggtattaaacagatatcgaagtctcaaaaacggaaaaattttatatgaagactttttcccacatggctctgtcctgcttagacagtccagacacattcgccatgacgaagtggggagcaaaaacagaaatgaagaacaacagttttatgctcagtatcaaaatattatttgtccaagctgtggtgccgagattacattaaaaggggacgaagcgcactgtccttattgcggtggttatatcaaaagtgatttctttgattggcagacagaagaatttttagtttatcgaagcctgaatccgaatgcatcctattataaattagttcttgcaaccatactcacttttttctttccgtctattccttgttttcggttcatccataacgattatctgatgtttggtactgcctttgcgcttacacttttactggctggcgcaatctggattttactcttaaaacaagaaaagaaagctcacgtttcgactgaccaaatcgtgcgttacgatgaaaaagttttaattgtagatctcaatgaagcactttatggtaccgagctaaccgccgatgccctgttttacagtgtcgataaactacagctgaaagacgtagaaaacacagagaatcgcacaacgattaccatttctgcagtgctgcacaaacttacacttcagccaaatcaaaagattctaaataaaaatgaaaaaataactttaaaattgtacagagcccgttatccacgacgcatgaaatcaaaaggacaagcagtgtttgaagaaaaagaatgtcctcgttgcggtgcaaatttcatgccggacaaaaatggctgctgttcctattgtggctatcagctatcaatagacaattcaaaatggcgaattgattacgagtagaatatcttatatttagtaagtggctgttgcactaattacttagtgcgacagccactttttctgagtttcacatataaaaaccagcctttctttattttcccatccgttccacttccactttctggttcaaaatgcctttcttccacaccatcacatacacttcaaactctacagaatcctgtgcatacacaaatggctcctgccacagcacttccgactcgattccttttgcttttaatgctttctgtctttcataagcctgttcgatttgttttttatgttctgcgtttgatttctttccaaacgaacgtttcggataattttctgcttctttttgaagctttttatctaagagtttgactaccgcaagatgtcttttttgatgtagcattttcgctataatctttgcaatcgtttttaccggatattgctcataaagtgccagcatctgtatcagcatcttatcctttacctgcattgcgagttctttcatcagacggatggcatcgagattcacttgccagggttcactttttggaacgacatattctggtttaacagaaggatacgagcaataatttaatggtggaaattctgccagcagggcaagctttcgttcttccttcgtacaacagtttttctgttctcccaggtaatccaccttgtctcttagaattgcaatccgatattctaactggcgcagatattcataaccttctacccagaaatgtccgatttttccatagtcataacattgaatttccagttttaatgactcaaaaaagatagtaaataccgaatcttcaccctgatttaccaccagaatgtactctttttcttttttttccaaaactgccttgattgtaccctcataatccggcagatattctcctgtaaatcttgcattttcaaataccagaaaactttccactgcatcgttcatcagataaaccagacgccagttattactgttgtcttttggtgctaaaaattcaagctgttctacctctacaagctgtgccagtttaaaaaattcctccggcatttcttctgataagccttgtaaaacctgtttgtaatataatttatcttcgttgtccattttttcctcattatcttttatggttttgatttatcgtatcataattggagaaatttaaaaagcccccgaatcttaaatccaaaagcttataaattcaaacgttttctataattagagcattatcgtttcactttaaatgcaacgtattttttttcgttgcatttttcgttgcaaattttgacatttttctgctaatcgttgcatttcaaatgtatcaaaaactctcagacttctgtccaagggttctaatttcttctgttttcttttatcttcttctgccttttcctgctgtttctattcttctgctgtttctgttattcttctctttgtttttgaactctcttatctacataagtctcttcgccactttccaggcaaattgcagcaagccttccacttggattgcacgctccacaatctattgcgatatgatttttctcccgataaatgtatcctggtctctcgttttctgcaattagctgggttggagtgtgtcctgttaccagataagtattttcaaaatactgccgtccataatctggtctttcccatacaatatcatgcagagaataatcttctatgtctttctccggtgaaaaatttccaagtccgccatgtaccagtaaataatttttcccttctattgtaagtgtttcatataccagaaaatcttccataaaatccagcacgtccagctgtgtttcctcatctaatctacgaaattcactgattgtcgtctctgctccgttatactgccaggttgccagattatccagaagtttttcgtctattttttcaatcgaactttctgtaatttcctgtcgaagaaatttcaggcatttcagtgccatcacctcatgatttccaacaaggcagactgcattaggcatttccatcaatttcagcaaagcctttatcggatgcggacctcggtctatcacatcacctaaaacatacaaagtatctgcacttgtaaatcgaattttttctaacagcttgataaataattcatattctccatgaatatccgaaataacataagtagccatgtacttctctcccctctgtccgtgctctttttctttattatacctcttgtctgtagaaccccacaagaaaaaatctcgcatagcatttatcttagtcggaaattaagactttcattcatgcaaatttattagtaagctcgtcaccagtcttatatcaccaaaataaaattctattgaaatggattgataactcgctacttatagaagcaggaatcttattgactaagataatgcaaaaatttaagcccccgaactttaagtccgagagcttataagatattttttaaactgcctctgcgattgtaatgcatgcataccgttcatcttcaatgatttttcgcatcatctcaaccggagtcattcctattccttcatccagatgctcaaaaattgtgacagcacttccagataaaagctgtactccttctctttttttatctgcatgaaaggcattgtgacgggaatctacattccagaaaacaacattcggaattgtataaccatttcttttaaatttctttttcatagtttcataaaacagccagtcagaatcataagttgcagagtcaaattccatatctgaaataataattaaagattttggcatttcttcttctggtacatgattttccaccgcagttttaagaatactatcaaaagccgcttccagatttgtattcaaaccccagtctgcctctactgcacaagcaactttttcagctaaagtttcaccttccaaatgcacaatgcttggtaaagcgctaaacgtcatgaaacgattatggtaatctcccttatttctttctgcaaaataaattgcaagaccaaccgaggttgccattggtcgtccatacatagagcctgaaacatctgccataacaagcatattttcatcaccaactccataatccggaagatttctccactgtgcttccaacaccttactatcctcgtttccgtataaaatcttttctactatatcataaggatacagtgttttagaatgaatgttttccttgccttccagtgccaggttgataaatttttcaaatctttccgtatcgtgtctgtcaaatgctcttcgatacttcatcatcgcacgtcccggaacggcagaataatcaatctcatcccaattgttgccacacatttttatttctgtaacatcaatatattttcttaacgtacggattattcttttaaagttataaactggatatcctaatttctctgcagttaaaatacctaattttcttgtttcttctacttttgaatcagcagttttcacccattttgcaagcagagacactggtttgcctaattgaaagttttttaaatcctccagtaactgtcttttcattgcagtccacattgcctcttctgccggtgtaccaatcagatagtaccagtcatcaaaacgaccatattcaccaatgaaatcaatgtttggaatcactgcctccggatgatattcagccagattctttaataaaatctgaaagactcttcgctctccaagaccctctcggatgtctcttgcataaaataaaattttaactgcagacaatggatcttcttcataagccttctcaaataaaattttgattcgttcttcatctgcagttctcagtgcaccgattgttgcaaacaaatccagattcgcattatctgttgtgttcactgctcttgcaccattttctgtatgagttaatttatttgatgttttctctaataattctacgaaattcattttgcttccccctataagttcaagccaaacgccaactcttatgagtgtttgattctacagagttacgatgagtgagggcaggactcgaacctgcacttcgtcctcttctcctggaataaattgctgtatgttccacaaacatgaaacactttttcgtgctttaccattaagctacctcactcagataaggcaggcaggattcgaacctgcatcaatttacttacattaaattagaaataagaaattaaaattgctgtatattccacaaacatgaaacgtgctttatctcatactctaccattgagctactgccttatatttactttatcttgttgacaagattagaataatccttatcttcagaaattggagtggattttttctttttttattattccctcatcaactgagcttatcttatcatactgtcggtacctccacaataaaccgccggtttaaaaataaaacaaatcgttaaagctcataaattattagaaccctcagacttctgtccaagggttctacaattcaaaaattcattttatttcttctcaattaatgccattcttttgtattttcatctgtaacttttaacgtatccttttgtattaagaaaaaatccacaatcgcaggagacgcagcttccgtattatcagaatcataataatattcctgcaatacatattcatccgtttcttcatctatatgcgattcattatacagcaaatgcagttctgttactgctccggtattttcatcaatctttttattaataacagcaaatggccagccttttgaagtcagacgaaactccaactgatacttcgtatctggataagaatccaagaatacatctgatttcgtttgaatataatccgatacctctgccaattcttttttgtatcgttgatattcttctgtcatcggatagccatcttcatcgtatttcgtattctcttcttctgtttgttcttctgctatctcatttaattcgtctaaagtttttccatatttcgtgttcagttcatttattttatattttccatcaaaaaaaagaagaaactgctcatcgttttgctcctctccatagataataatttcaacctggttctttttccacgtaacctgccaggtgtcctgcgaaatatttcccccatcatctcttagcgaaaatttaactttactgattcttttttccccttttttcaagataaactgaccatccgcaggaccgaaaaataatggctcccccactgcctgcatagtcaaagaatactctccatccgaagaaacacttgtgtctacattcgaaactttaaaaacaattagataataaaagattcctacaaagcacaataccgtaatacaaagtcctgccagaatcccaaacaaaccttttattattgtattatgtactttgatacagccgattaccaaactcactgacagcagaatccatatgaatagaattaccatcttattttctccagtgtctttatcaatatctcactactcttttcaactactgtacaattcattttttcaattgattcatcaattccaataattccatttcccagtcactgattctggaataccagatacatccataagcttcacgaattttaatatttaaagacgaacagataattactttcgtatctattcctctttcttttaaaattccaagcagtttttctccggcatcgaaatctccctcttcgccttttctcatcggataatgcatatctgtaataattaaatcaaagggatttcctgcttctttttcctggattaataattctaatccctcttccacattatcaacctgtgtaacatctgttacgccacatctatcatctaacgcttttttgatatcatttgctttatacacgtcatcttcaaaatttaaaattctcatttgcttattctccgttcaaaattctctgatatagttgttggactacccctttggcaagctgtttacaaatttccatttggttggtgcctgacacctttccttttattatacagctacagcttgaagccacgcaagaataaacaaaataattctccataaagcaaaacgaaagcctctaaagctaatattctgaaggctttcaatcaattttttaactgattcgaatttctcttttttcttgaatatcctttggcatttgtacaataattttcttagcaatcgcatcttcaagataatactcatttaatgtatcttttaaatatttttctcttttattccttgttgcgtctatcaacatatctgtaaaaaaacgttcccaacttacatatttctcacattctacatattttgatgtattttctaagatatcatctaaattttcgtattttataactcctgattttaatattaaatattcaaaagattccggaagccaaagagatattctgcggttaaactgcgtttcaaaataatcaacacaattttcaatcagtgcaccaaatgccgcgccatctgcaattactagtacatctttgttatccaacatttttactcttcactcgaaactcataattacccttcatctgccatttcctccgcttccaacaattcttctacatattcccgcggattatgcacaatttttcctgtattcataatttcaatttcaaagtttcctttaaaatgcataatatgcctcaagtatataactaaatctttctgttctgcaattttcaaaatccactttgcacagttatctccgcaatttgacgcattatatacaaaagaatcatctttcaacattaaaataagaacctttactcccccagataattcttttggcgtaatcgctcccaaaatagggctgtcaataatatgtgaactaattacagttgaactgtccacatctaaaatcatctctttgacaaaagaatcttcaatcctctcatcttcatatacattatcaaaatatgactgagcatctttcatatactcagtacccgaataataccatatttttagcatttttctctcccatttcatccttctacttcttagcataaaacggcagaaatatgattactagtatttctgccattttttatcacttcttcacactattcaatccatccacccaattactaaaagcttgaccacaacaaataaattgagcaaaactctcaactttccacctgaagtttctttttttcttacatgtttcttacagacaaatttcttcaattacacattcatgttttttactctttttatcgtagttaatccctgcaagaagtaaatttcctttatactcttttaatgtttccacataatgccgttcttttatctgttcaatcgctccttttgcatctttatcccattttagttcaataattactgctggtttttcgctatgaatttttcttggaataaagcaaatatcagcaaatccttttcccgatggaagttcccgaacaatcgtataatattctcttgcaaaataaaacgccagattaatggtacagctcaatgaattttcatcattatattttaaaatagagatttctcgatgtgccttatcaatcccttgtgcaacaaccacttcatcttttctccacagtgcctctaataattttttcgatgcatctacagaatcaatcacttctttccaatccattgtactgattgcattaatatattcctgagaaacctctttattcggaattgataccgttttttccatccaatgataactcagatatcccaagtgaactaacaaagtcaatacatcatcttttccctgaaatgttgtcatatcattagaaaatgttccaatattaatcggaacagcttctcctgccagcatttttacaatatcatcttttaatccttcaaaattcatgcgaatataaatttttaaggcttcataagtctccgtctgattccagtaattatcaaaaattccacttaacattgcatcaactacagattttggactgtacattgcataagtaacaagctgattttccttcatcacagttaattcatacccatcataccaagcctgtgtttcttcaaaacttctgccatattttttacagagacttctcacttcttcctctgtaaatccaaaaaattctgccatctctcgtggatttgtcatcgagtattctgaaaacatattcaatgcagaatgagaaccatactttttaattggcaaaattcctgtcatataagcaagtgccacatattccttatccttcagccacgctcgtaaaaaatccagatatcgtttctgcgcttctttgtcattttgatactctcggaataagcaatcccactcatcaatcaaaatcacaaaagaatgtttcgtactcgcataaatatctttcattacctgaattaaatttttctcatctctaagccgaacttgtccaaatgcttcctgtaaatcaaatatcaaatatctgcgcaacatatctaacatttcttctacacttgtcgtttcacttagaaattcctgcatattaatcttaatcacatcgtatttatttttatgtttctgataagattcacattctgctatctttaaattctgaaataattctgttgactcctcttctcgctcataataagcagtaagcatatccgcagccattgattttccgaatcttctcggacggcttacacaaacaaatctctgcattgttcccacacaacggttcgttacttctattaaattacttttatccacaaaaatctgagaatttaatgcaatttgaaataatccatttcctggattcaaataagttcccatacgccgtgcctcctaaatttttaatgtactcttattatactgcctttgatttaagccacgcaagaataaacaaaagaattctccataaaacaaaagcctccaaagctggcactctgaaggctttcgttttgttttatggaatctcatcacattccttagctgttattcgtattgttttttactttcatttaatttttcagctgaatttgattgacatctggttccttttattgaaaattataatctatttttcttcttttcgtttactattggtatgaattcctctattctcatctcctgcttcattaactccaaattcgtagtcatttcccggcagaataatatttaaggcaattcctgcaatcgctgcaatcgcaagtgctgtcaaagtaatcgaagttcctgctaccgtaaaggtaattccaccactgaatcccagaccgcagacaaagataacgcctgcaataatcaggtttctggattttgttaagtctactttattttctacgacattacgcacaccaattgcggaaatcattccgtaaagcatgaagctgactccaccaataattgcgcttggcatggtactgataacagcggatacttttggaataaagctgacgataattgcaaacacggcagcaatacggataactctcgggtcatagactttacttaattcgagtactcctgtattttctccataagtggtatttgccggacctccaaacaaaccggaaacagctgtcgcaagaccatctccaagcagagttctgtgaagtcccggttctgcaaggaaattttctcctaccgttgcggaaatcgcagacatatctcctacatgttccatcatagttgcaatggcaatcggtgccataacaagaaccgcagttacatcaaatttacaaagctgaaatcccggaagtcccacccagcttgaacttgcaatagatgcaaaatttaaaattgcagaaccatctggattcttaattccacacgcattcataatcattgccactgcataggaaatcacaacccccatcagaatcggaatgattttaaacattccttttccccagatattaaacacaatgataactgcaagagcaaccagtgcaagaaaccagtttgtggatgcattggaaattgcagagcctgcaagacttaaaccgatacagatgataaccggtccggttacaacaggcggaagataacgcatcacacgtttgactcccacgatacggataatcagtgcaaatatcagatagaaaagacctgctactacaactcccccgcaggcataagctgctttttcatttgctcccatagatgcatacattccactgtttaagtttgccactgtggaaaatcctcccaaaaatgcgaaggatgaacccaaaaatgcaggcactttgaatttggaacacacatggaacaacaatgtaccaaatcctgcaccaaataaggttacggaaacagtcagaccggttgtaagcggttccccacacgcctgaacaaaatagctgttgaccagaatcggtactaaaattgttgcaccaaacatggcgaacatgtgctgtaagcctaaaatcagcattttaggcacgccaagttttctggcgtcacgaattgcttctcctctttctcccattttttctctcctctttcgtttttttatctttcatgtgctctcggaatttttttgagagtacatcttccccattatagaggagagagtcctgttatggcaagcaaaatcagagaatcctttcaaaaatcatacaagtttataatgcaaaaaactctttaatctgtcccacaataatctgcatcagtctggttctcgcttccacacttgcccatgcaatatgcggagtaatgataagcttcctgctgtcttttatttttaccaatggattcgtttcactcatcggttcttcacataacacatcaagacctgctgccgcaatttccccggtctccagagcttcacacaaatcctgttctaccacaatcggtccacgtcctaaatttaagaaaatcgctgtctttttcatttttgcaaatgcttctttattcatcaaatcttttgtatattcatttaacggagcatgaacagaaacaatatcggatttggaaagcagagtatcaaaatctacctgttcatatccttcctgtgcgcttcttccggaagccgaataataaaccacatgtgcaccaaatgctttcgcaatatcagcaacccgtcttccgatcgttccaagcccgataattccccaggtttttccgctgatttcattaaaatgctctgcaaaatgcgtaaaaatcgtatcattgacatatttttccgttttgacatactcatcataataacgcaatttttctaataaatagaataacagcgcaaaagtatgctgagtaacagactctgtcgaatatccggctacatttctccatgcaattccacgtttttcaagatattccttatccagattgtttgttccggtagctgttacgcagactaactttaaattttttgctgttccaatcgtctgctcattaatctcaatcttattaattactaacacatctgcatcttttacacgctccggcacttcctctgatgtggaaaatccatatttcaccacttctccaagcgcatcataggctgataaatcaatgtcatctcctattgtctttgcatccagaaatacaattttcatgatccatctctcccttaattaaatttctttactcatttcatcataagtgcaaaagttatatcctaatctctgatatagcgcaaccgcacctgcattttctttttctacttccagacggaatcgtactgcatctgtatagatttcttctactgcctcaaaaaattttcttccgattccgtgtcctctatactccggtttcatatacaaatcttccaaccagatacacactccgccaaattcggttgaatatccggtcgctgcaattccatatccggcaatttcaccttcgatttcaaacacatatccatccacgtatgggcagtctccaacgcaatctgaaatatctttctgtaatgtttcgtcatccgctttatgaatgaccacatccgatgcataaaagatctgcatcatttctaaaacctctgctctgtctttctcctgcatggaacgaattataacctctccctttttcatttctaccttcattgttagtatcctttccttatgaaatcatgttctcctatcaccggaagctttttcacatccatatttgtaatcaaaatatacgtctgtgaattcaaatactgaatgagttggtcaatttgctcttctaaaccttgcacttcggcttcgaccgtcccatcgtatttgttttttacccagccggttaatccaagctgccttgctttatgtacgcaataatatcgaaatcccacgccttgtacatgcccataaaaaataatatgtctgcgaatcatccatacactcctacatctttaaaatagtaaaaacatttttggtataaatactatatccgttacgttcagaattttctccctcaagtgtttcgttgctactatcatagggtgagtaagagacttttgtcaagtctaagaacgtaagtcaaaaaaagctcccaataagctgaaatttcatgcctgttgagaacttttttctaaaaatattttaagattattttaaaatttcaatatctgtctgtattacctgtggttctttttttaataaatattctccatttcgtacagaagccagaattccggctcgttcgcatactgcatcaaactctgatttcgcttcaagtacaataaagtttgccggtttgccctcttctaaaccatattcgtcctgaatatgcatggtttttgctccatttacagtaattaaatccagtgcattgtcgatttcttcaaatgacatcatctggcaaatatgaattccgtgatccagaatcatcatcatgtttccatttccaagaggataccatgggtctgacatcgaatcctgggcaaagcagacattaatctttgcatcattcaattcttttactctggttaaccctcttcgttttggataggtgtcctgacgtccctgaagataaatattttctgtcggacaggagataaaattaatttctgctttcttcaataatttcatcaaacgaaaggcatagctgttatttgcagaaccaaaagaacaggtatggctggctgttgttttacttccgattccttccattgctacaaccagctcggtctttatcagctgttttccgatttaaaccagactcctttatacgaatctttcatggaaaatcaactgggtgtactcatccgctatgacgcagataaccacacccagttagttgaaacgttatctctttatttacaaaataattgtaatattctgcataccgcagatgctgcctatacccatagaaataccattaaataccgcattacaagaattgaagaactgttacgtgttgatttacaggatgcttctgttcgtctgaacctgcatcttgccctttatctgcatcagttcatcttaactacatgatttacgcatgccagatatcgttattatattctgcaattgtacggtcagatgaaaaatatcctgcctttgcgatatttacaatcatcttctttgcccatgcttttctatcttcataagcttttaaggcttcttctttctttttagtataagccttgaaatccaagagtgtcataaaccagtctttatttaacagttcattctgaagtctggttaagttttcttcatgaccgattgcaagcagttctttagaagtaataaagtctaccgcttctttgattgtctcatctttttcgtagaagtctctggaaacgtagtctgcattttcatagtgtttgattacttcttcgctggaagctccaaatacaaagatattatcatcacctaccagttcatggatttctacgtttgcgccatcttctgtaccgagagtcagcgcaccatttaacatgaacttcatgtttcctgttccacttgcctctttagaagccagagaaatctgttctgaaatatcacatgccggaatcagtttttctgcttttgtgacattgtagttttcaatcataacaacctttaagtatggactcacttcagggtcattgttgattaattcctgtaaacataaaatcaagtgaatgatatcttttgcaatcacataagccggtgctgcctttgctccaaaaataactgtgattggagtagatggtttcttacccgccttgatttctttatatttatgaatcacatataatgcgttcatctgctgacgtttgtactcatgcagacgtttaatctgaatatcaaaaatagattccggattcaattctacattttgagtctgttttaagtaatcgcaaagtgcttttttgttatctgcttttatatttaataatttttcaatggctgcatcgtcgtctttataagccaggagtttttccagttcctctgcattttctctgtatccggttccgattaattcatcaagcagagcggtcaattccggattgcagtgaatcagccatctgcggaatgtaattccatttgtcttattattgaatttttccggataaatcttataaaatgcatttagctctgtatcttttaagatttctgtatgcagagacgctacaccatttacactgaaaccgtaatgaatatcaatgtgtgccatgtgtaccacatcatttttatcaatgattacaacactttcatcatcaaattttcttcttactttatcatctaaaatttcgataatcggaaccaactgaggaacaactttctttaaatattccatcggccatttttcaagtgcttctgcaagaatggtatggtttgtgtaagcacaggttttggttacaatctcaattgcttcatccatctggattccacgtgcaaccaacaaacgaattaattccggaatgaccatagtcggatgagtatcattaatctggataaccgcatattcatacagatcatgcagatttgaaccacgtgccacacattcatccaggattaactgtgcaccattacttaccatgaaatactgctgataaatacgcagcagacgacctgcatcatcactgtcatccgggtataagaacagtgtaaggttcttttcgatttcttctttatcaaaatcaattccttcttttacaatgctgtcatctacagattctaagtcaaataagtgaagtttattgctctgattgttgtatccggttacttcaatatcatacattctggaatttacagtcagatttccaaaagttacaggataactcacctctgtttttgtcagccagctctctttttcaatccatgggtttggaactgcattttgtaattcatctttaaattcctgtttgaataatccaagatgatagtttaatccaactccatctccgcttaatcctaatgttgcaatagaatcaaggaagcaggcagccagacgtcccagtccgccatttccaagagatggttccggttcaatttcttcgatttcgcaaatatcttttccattttctgcaagcatttttttcacatcatcataaataccaaggttaatcatgttgttggataataatttaccaattaaaaattctgctgaaatataatagatttttttcttctttaccggtacttctttgtccttcgccatgttctgaacaacatgtaacaatgcataatacacttctgcattagatgcttctttgattgtttttccaagttttgtttctaataattcctgaattttcatcataaaaaaatcctccatcattctctttctttatcttgctctaaattctattttcctgttatcctgtcgtgtttcttatctgcattttactatgctttttcaattatttcttgcaaaatactctctatttataatacaatactatcaaaatataatttacaaattttgtataaaaatggaggaatttgttcatgaacctcacagaataccaaaattaccatgagtcaaaatctcatacttctctcgaatttccttataatacttacctttgctgtatccctatggactttacgcatgttcccattcactggcacaatgaaatggaattaattgtcatccagaaaggcagtggaatcatctccgtagactttattacccatgaagtaaaagccggagatattgtctttgtgcttcccggacaactccattccatcaggcaaaaaaaagaagcacggatggaatatgagaacattctctttcatccatctatgcttctttgtggtgaaccggatttgtgcggaacaaatttcattcttcctcttatggaaaatcctgctaccattcagacctttctcactccagatgcccctgcttatgaatctctttccggatgcatccgaaaaatcgataatctctgcgattccagaccaaaaggctatcagcttgcagtcaaaggctggctcttccagcttatgttttatcttgtgtccaatcagcagacactaaaacagccttctcagtctcaccaaaaacatatggataaactaaaaaccattttaaaatatgtcgaagaacattacaacgagcctttaaacattgaagatatggcaaatctcattcattacagcaaatctcatttcatgaaattttttaaaacacatatgaatatgggattcacccagtatctcaatcattatcgaatgagcatggcggcaaaacttttagtttcgaccgatgattctgttttgacgattgcagtctcttccggctttgataatctttcgtattttaatcgactctttaaaagagaatttcatatgacgccacgagaataccgtcgtcagcaatgatacgtttgacacttacatgattcttttcaaaaaaaccttattgagcttccgtttttttaactcaataaggtttttgttctatcttgattctatttttattctatttttactttatttgcttttcactgctcctgcaattttctctacaactacacaaagcacaactgtaatcaccatatccggtaatgtatttcccaccggtgtatctacctgcatcagcagacgataaatcacaaaaccaacaagccaaacagccagatttctccactgaaatgcagatttttgggcatctgccttttttaacataaagtaatctgcaatttgcactgcaatcatcggtgcaaacacagaaccaatcagatataagaaatttgtaatgttatccattggatacacaattgcggcaatcgttccaattaccgtaacgacaattgccgcccatttttcctggattttagaggaaatcgatacactcgaaactcctgcggaataagcatccaaaaaggtagttgtaactgtagaaaatacaataattaaaagtcccacaataccaaaacctgtttttaacataatctgcgcaatgtcatattcaccggtaaaaatagctgctcccataccaatcatatacataaaaatgctgaccagactgtaaacaactacacttgcaaatgtcgctgcaaatggtttttctgcttctcttgtatagtcactgatcagtggcagccaggaaagcggcattgctaccgcaagctctactgcggctccaaatgtcagacttccatcatctacaattgccggcatgcttccatttccaaaaaagataactttaaaaagtaccaacgataagataaaaagtgcagtcattgcaacggtgtttaatttaccaagatttgtaatcccaatcagaatccatacaataatcagaacaccgataataatcgcccaaatccaaatgccggtatgtagcacaccatctgctgcaagtgcaccgtcataaatcataattgcagtccaacccacaagctgtaagacatttaagatggcaaataaaaggcttcccctttcaccaaaactcatttttactgtttccatggcacttttacgttcttttgcaccaatcattcccgctgcaaacatcataagtccgccaatcagatgtcccagtaaaatcgctgccattgcttttccaaagccaagtggtgcaaaataagtaccggtcaggatttcagctaaagatacccctgcaccaaaccaaatcagtccgtttgaaaaaacggaagttctcttttcactcatccctcgtactctcctttgactgcaaatgcatggttcatcggtccgcttccttttccaaggtcaagcatagcggcaagcgcgccggaaatataattttttgcatattttacggaagtttccaaatctcttccttttgcaagatttgacgcaatcgctgaagaaagagtgcagccggttccgtgtgtattggaattatcaattctctttccatggaaccataccggcgcttttcctttttgaaaaagcaggtcgttcgcatcatttaactgatgtccgccttttaataaaactgcacagtcgaatttctcacaaataagctctgctgctttttccatatctgcttctgatttaatttccatctcagaaagaacttctgcttccggaatatttggagtaatcactgttgcaagcggtaatagtttacttttcaatacactgatagcatcttcactaatcagtcttgccccactggttgccaccataacagggtctactacgatattttttgcgtgatactcagtcagtttttctgcaatggtttcaatcagctcacttgaagaaaccattcctgtcttaatcgcatccggataaatatctgtaaaaatactatcaagctgctctgccaaaaattttggtgttacctccataatatctgttacgccagttgtattctgagcagtcaacgccgtaatcgcactcatcgcatacacgcgatttgcggtcattgtcttaatatctgcctgaatgccggcgcctccactggaatcacttccagcaattgttaatgctgtgtacatcattttttcctccttgttctttgcattaattttatagagcgacaaaaggtggtgcccccaatctgccgctgttatgctttgaatctttcaacgtattttaaaaatgcaggaacccaacgaaagattcctgcatctaaaacacatatctgtgattcattatctccctacgttggcattacccaaatcaggttccgggttaaagcatccgcttactctcagcctgcttacgcaagcaccccgctttttataacaattttattatacacccttatcttgaaaatacaagtttttgatgctatttttaccttgaacccaaatagcaggtgcaactgatatgataatctgtcgcacctgccatcttccttcatcgttcttacgatcgaggtaaagccttttccactccaataatttgttatatgcttttcttcaagatttcaatctcgcattttatgactttcttcaagattttattttacgtttttatgactttcttcaaaattttatttttctaccggctcatccatcttgcccaggctgccagccctgctccatgttttatttcacctgatgccaccattcttttaaattcttctatcgagacttcatgaagtttcagcacctctgccgggttcaaaaattcctccccctgttttccacaacaaattgcaaaaagatggattttctcattcgtcgaaccaaacgacggataaaaatctccaagcagaatcacctcttctgcttcatatcccgtttcttctttcaattcacgtactgctgcctgctctgctgtttcccccgggtctatcagtcctcccggaagctccgtctgccacaagcggattggataacgatattccttcagcgtaataatattttctccatgaaacggaagaatacttactccttcaatcatttcaagataatcataaggtcagatctgatttttcacccgtactttatcctgtacaagtgtaaagcgacccagctttattttctctgactctactgtttcaaatggactttttatttccttcatatttcttccccatttgtcttaatgacatgtttataccaatacgccgaatcctttagaattctctgctgattacgataatccacatacacaagtccaaatcggtcagaataaccttttgcccattcaaagttatccatcaatgaccactggaaatatcctctgatatccacctctgttgcagctctttttagttcatgcagatatcttccaagaaaatcaattcgattcggatcatgcacttttccatccagtgaaatcacgtcatggcaagataaaccattttctgtgatataaattggtttttgatatctttcatataaaaattttggtccccaatataaacattccggagtaaccggccactgtatcgctgttttcggaaaaccttcatatctttgaacggcctccggctttccattctctcccatacgataagcgcagccattatagatattttgtccatagacatcaattggttcagaaattaatttcatgtctgcatctgtaattttcggaagatatttttcataacgaaccaagccttcttccggataatgtccaagcagtaccgggtcagaccaccacgctacattccaggtccagttactgtcatcttcctgcatggaaaagtacatctgtcttgcggcttcaatatcttccggacggttagtctcaggatagcagacagaagaagtcggagcatatccaatcgtcagcttttgttttccataagcgcgaagcatctgcactgcacgcccatgtgcttttaatgcattatgtgccatctcaaacgtatctcttaacggtgcttttacacccggcgcatgctctcctgtaagaaagccaagtcctacgaaacactgtggttcatttaaggtaaagaaatgtgttactcgatcagtaaaacgctctgcgacaagctttgcatattctccaaaccactccacaatttgcggattcatccaacctcctcttttataaatctcataaggaagttcccaatgatacagcgtaatataaggttctatctcattttccagcaactcatcaatcagtgcattataaaatgcgattgctttttcattcactctgccatatccttccggaagtacacgtgaccaatcaattgaaaagcgatacgcttttaaaccgattgctttcattagctgtacatcttctttgtatctgtgataatggtcacatgcaacctctcctgtatgtccggagtagatctttcctggttcttttgtatatacatcccagatgtgttccccttttccatcttctgtcacggcaccttcaatctggtaagcacttgttgcagcgccccagacaaagttttctggaaatttaacttctgtttttgccattattttcactcctgttcttgttttaatcttaaagcaaacttgcagctccaatcattccggcatcatttccaagtgctgcgcagtctgcaacatgtggacaactgcttttatcttttataatcggaacacggttggttacagcaagtgctttttcaatgtgtaaatctcgtttttttccatcttttcccactctgccgtaatcatacacacgataagtcacattcgaattttgctgaatttcagcaatcaaaatgcctgcgccaatcgcatgaatggttccggattcaataaaaagcacatctcctttttgtaccggaactgcatttaatacttcaagtaatgtgtcttcttcgattcgttttgcaaactcctctttactgatttctgttttaaaaccataatacaaataggcacccggatccgcatccatgacataccacatttctgtttttccgtactggccttcatttttcaacgcataacgattacttggatgcacctgtacggaaagactttgttttgcatcaataaattttgtcaagattgggaaatcacgaaatcttcgacagttgagtccaagcacttctttgcctttgatgtcgatatattcctgcagtgttttccctgcatacattccatttgcaatataagatggcccgtccgaatgacaggaaagctcccaggcttctgcaagtacctttccatcatattttacaccatactcttctgccagtctatgaccgccccacagataatctttacagcttggtttcaattttaaaatactcatcttttatccgcctctatcatttctcacttaaaaaatcaatatatttctgacacatttctttatgggttccggtcgccggaaaaacaagcacaaggtcttctttctctgttccatcaagctcactttccagttttgtaccagttaaatcaattgcttttgttccttcagcttcacagagattcaagtcttttatctcaaattcatcggcagagtaatactctccgccaacactggtgcagtatttcagaaagtcttttgtcagaatcactgcatctaattctcccttagaccactggaagaaaaatttatcaaatccgctttcatttcctgcatcctgtttttcttcagcttccttataagaaatcacatagtctgaatcaaatacgattctttttgcatcaagacctgaaaatgtggcaaattcttctgataaaactacatccctgtctgaatcaattttctgattcaccaaggcacatttaaaaaacggtttttcttctggaaatgcaaaatggacaaccaggaaaatcaagagagcaaggactgcaagaatgcctaacatatggtaccaaataacattttgttaacacttaattaatttaatcccgattttttagtagtatttgccatattcttgcatattttaacttaatttaagattaataattgaattaaattatttttttttagtaaaaaagaccagtgagtgcatattctcaccagtcttttaagttctttaattaatttactatttaagttttacacttttcttaatcaccatgtggccagatacaatgtccattccatgtccacgttttggatttttaatctgtttcagcactttttctaatgctacttttgtcattgcttttgtatttacttcataagttgtaatctctctatccgcaagtcctggatagagataattatcgaatccaacaacagaaatatcttccggaactttatatcctctttcattcagcttatcaatcagcatatacgctgcaaggtcacagctacagacaaagcctttcggcagtctctttggaagtttaaatcccatctgtcccagttcacccctgtcctcaatgagccactgtggttttatctcttttttgtggctcatcattgcttttaagaatccgcagtatcgatccataatactgcttgttgaataaatcgagccaacaaagccaagttcttcaatttcctgttcaaacatgaattctgtcaacagatatgttccataaaaattatcggtaacgactgcatcctttgcaaagtctttatcataataatccagaaataccaccggaatccttgctgtttctgtcagctttacaatgtattctttattaatttttccaagaacaatcagtccgtccactttatttccttccacacatgccggaagttttaaagtatttctttcatcttcttttcttaaaatttcaactgctgcaaaacagcgtttttctgttgcagctaccgcaagttcctgatacattttccaataaaatgtttcgtactgtgcaagataattttctgcaataagcacaccaactgtataacttgcttctcctgctgcctctcttgctttctgttttcgttctgacaaaatctgatagcccatctcacttgccacactttgaatcttttcacgcagttcttcactgacacctttatttccggcaagcgcattatgaaccgtaaccgtgctgacacccacttttttcgcaatgtctgccagcctgacttttcccatctttttcacctcatctattcttttaatctttttcatctacttaaatttaagttaattataaagggattgggcttaagctgtcaatggacaaaaaaagaagacgagcctcgatgatttcgaccacctgtactcgtcttttttatattcttatatttttatatttttaaattactccatacttacccgctcaatatgcatcgcaagatatccaatctcaatctcttcaagttgaacccgaagtgccttactcaaatggtcacagacaattcttgcaagttcataagactgtggaaaattgtgctccacataatcattcatatttactttcagtgactctttatttaatgcccgtgctaccatgaattttatatggttcatcaaacggttataactcaaagacattacatcaatatgaatctttctctgtgcttcaatcagcgaaatgcattctcttaccgctcttgccatctgcatagaaaccgcaacggactctttttcaagcgctgaatgaatatgcagtgcgacatatccaatctcatcatcctgcacatcaattcctttttctttttttaagcgttcttttagtgccagcgcaactttaaattctccataaaataacgtcttaatatcctgggttaaaggatttgaaatctgttctcccttttgcattcgttttactgcaaactcgatgtggtctgccatcggaaacaaaatactctgatcaattgttccaaactgttctcttgccagattcaatatctgatttgccatttccagatattcaggctctatgcttcttgccagttcagaggctgctcctcttgatgaagtttcctgcaacgaataaacggtacactcttctggttgttccattcgttcgcctactttttttccgaacccgactccttttccgagcaacacatattctttattatccttcatatcaagcgcaatcaccccattatgatttaaaactttgcaaatacgatacaccgttctcccaccttttcccaggattcccccgtttttttctaaagcctttttgaccccaactttctatctctactttagcatatttcctgtcattttcccactgaaatttcagttttttgagaactcacaaattctttttctcagtttcaaaatcatacccggagcaacagagagttcatccactcccatcttcataaattcatcggtaagttccaaatctgcacctaactctccacagattccagcccattttccatatttatgagcgttttccactaccattcgaatcatcataaggattgccttatgatgcgcattatagaaatcatccagtttctcgttctgacggtcaatcgccagcgtatactgagtcaaatcattcgtaccaatactgaagaagtctaccatctgtgccaggtcttcactaatcataacagccgccggggtttcaatcattactccctgttccggtactttatacggaatttctgcggcatccagttcctgttttacttcttccacaatcgcaaaaatctgctctacttcttctgtagaagtaatcattggatacataacagacagattgccataaactgccgcacgcagcagtgcacgaagctgggtcttgaaaatctccggctgttttaaacagatacggatcgcacgatatccaagtgccggattttcttcttttccaagattaaaataatctacctgtttatctgccccaatatcaagggtacggataatgaccttttttcctgccatcagctgcaatgcctgcttataggcattaaactgttcttcttctgttggaaaatctgtttttccaagatataagaactcgcttctgaataaaccgattccttcggcgtcattttccagtacaccggcaatgtcgcctacactgcctatatttgcataaagatgcactttcttgccgtctgctgttacggtttcttttccttttaattcctgcagcagttttaatttttctgcttcttcacgcatttttgcttctgtttgttgttttacttcttctccgggttcaacaacaaactttccttcaaatccatctacaacggcttccattccggttctcaactcttctaaatcaaccggaacaccaatcaatgccggaatattcatcattcttgcaagaattgccgtatgggaattcgtagaaccatgaacggtcacaaatccaagaattttttctttatccatctgcacagtctcacttggagaaaggtcatctgcaacaatgatggatggctccatttcacttaaatcaacagaaacatctcctcttaagttttgaaccagacgatttgaaatatcttttacatctgctgatcttgcctgcatgtattcatcatccatacttgcaaaaatctcagcaaaattatcaccggtcactgcaaccgcatactctgcgtttaccagttctgtctgaatcatattctgaattgcatcctgataatcttcgtcttccaacatcatctgatgcacttcaaaaattgctgcgcttgcttctccgacttcttttaccgctttatcatataaatgctgtaactgtgcctgtgaatctgcaactgcctgttttacccgttctatttcctgcttagcatcctcgattttttcacgttttacctgaacatcattcttttttaataccgcaatcggtccgattgtcagacctctatacacggactttcctctatattcacgttccattttcatttcctctcttaaaaacggtcagataaaaatctgaccgccattttttataaattttcttcgaaaaatgctttcattccttcaaatgctgcctcttcgtcagcaccatcaatttctactcgaacatcctgtccgcattttacacaaagtcccataactgccatcagtcttgtcacatccactgttttttcccctttgctgattgtaatggaactttcatatttttttgcctcttttgcaagaatacttgccggtcttgcgtgaattccctgttcatctttaattgtgtaagtaaattctttcatgataatttctccttttattttttattttcttatttttttatgcttcataaatatcaattgcatataacggtgctcccgctttgatttctccgcttgcaagcagtctgactttctgattatcctctaactctgtacacagaatcggagaacataaagaaggtgcattggctttaagatactccagatcaagttccagcaatttatcacctttcttcactttctgtccgttttctacaaagcaggtaaatccttttccatccagttttacggtatcaattccgatatgcagtaacatggaaagtccgctgtcactcataaatccaattgcatgctttgtatcaaaaacaaaagcaatttccccatcttccggagcaacaactacaggatttgtaggtgttaccaccgctccgtctcccatcatttttcctgcgaatgcatcatccggcgcatttgccagatcatctgcaattccggtaatcgggctggaaacgataatcgtttcttttacttttccagtctgtttttcttctgttttctcttctgtttttgaatcggctgtttcttccattgtatgaagttcttcatccggagctgtttccagataatcttcaaagtttgatttaattacagtaacttttggtccgtagataatctgcacaccatttcctttatgcaccacaccggatgctcccgttgcttttaaaattgtatcatttaccagctctgatttatgcacggtacaacgaagtctggttgcacaacaatctacgtctgaaatatttttcttaccaccaagacctcttaagattccttcagaaacctggtcctctgcagatgcacttttttctccttcttttctggcattaacatctgctcttgtgtaaagttttacttcttctacatcatctctacccggagtttttaaatctaattttttaatcaggaaactaaacagcacatagtaaacaataaagtataccactccgacaactacaatccaaatccaatttgtctttttatttccctgtaaaataccaaataagaataaatcaataaatccaccggagaatgtcattcctactccgacttttaagatatgcatcagcatataagcaagtccggcaaatacacagtgaactccgtataataatggtgctacgaacaagaatgtaaattcaagtggctctgtaatacctgtcagcatagaagttaaggctgcagataaaagcagaccttctaccgcttttctttttttcggttttgcagtacgatacatggcaaatgcagctcccggaagaccaaaaatcataagtgggaacttacctgacataaatcttgtagcagataccgcaaaatgttctacactcggatcagataactgtgcaaagaagatattctgagcaccttctatcatctgtccgcctacttctaaggtaccaccaactgctgtctgccagaatggaagataaaatacgtgatgaagaccaaacggaattaagagacgttccataaatccatagacccaggtaccggcataaccggaacgaagtactaaatctccaactgcataaattccggcctgaatggtcggccatacgaaaaacattgcaataccaaccactacatagacaagccctgaaataatcggtacaaatctggttcctccaaagaaggataatacctgaggcagctcaattttataaaagcgattgtgaagcgctgcaacaccaagtccgacaacaatacctccaaatacacccatctgtaaggaagtgattccacatacatctgtagttgcaccggaaagcatagcttctgctccgccgttaatatcaattaatgctccaatagatgcatgcatgatgaaaaatgcgattaccgctgaaagtgcggcaacttctttttctttctttgccattccgattgcaactcccattgcaaatataatcggaagattcgtaaaaataatatttcctgcggcattcataatctgtaaaacctgattgattatggtgccaggtcccattacatttaataagccatatgcttttaacatggtctcatttgtaaaagaaccaccaagtcccagtaacagaccggctaccggaaggattgcgattggaagcataaaagaacgtccaactctctgcaaaattccaaaaatcttgtctttcatgattttctcctcttttcttttttttagtatatccgtttttgagttcttatataggcaagtcttttttagccggctgttttccacaaaatttttttatggaataaaaaaggcactaaccctacacaaatatctcaaaaaaaatatttatgcacagttaatgcctgcttactcagtaacacactatgactgagattacttataccataatttaaggttgaagtcaatcatttttgcaaaaaaatcatctttaattagcaactggaaaattcaatacaactcgataattccacaatatcatcaataccgcactttagaacattgcatatacgttctaagttttcaagaacattttaccaacaaatttatttaatccgtttctggatatcctcaacagatggtaattgcttttccaaatcatccggcagattactggttattttgtattcgctcacacctatcggttttgaaacatccttaagtgaatattctgcaaccacattattcttacttttacacagaagcaaaccaatagacggattgtcctgttcttttttcaaaataccgtctacggctgacaaataaaagtttagctgaccaacatattccggtttaaagtcaccggttttcaattcgataaccacataacagcgaagattcaggttataaaacaacaaatcaatataaaaatcatcaccgcccacattcaagtgatactgatttcctaaaaatgcaaatcctgttccaagttccagaagaagttttgttacatcccgaaccaatgcctgctcaatatctcgttctagcatatcttccttaaaaggaatgaaatcaaaaacataagggtctttcattgtctgcatcgcaagttcactctgcggagatggtaaacgacgttcaaaatttgtaatcttgtctgccagaacctgacgttgatacaatctactttcaatctgatggacaagaacatttcgtgaccagccgttttctgctgacttttgaatataccatttgcgttcatctatatcagcaaccttatccataagaacaatattgtgaccccacggaatttgtgcaacaacctgttgcacaaattctcgttccgaataagtctcagcgaattttgccatatactttaagttacgaacagaatagcctttgctttttggaaacgctattcgaatatctgctgcaagattatcaataaatttgtttccccacaatttatgttcattaatcacacaaccaatatcataatacagtagtaacatgtctgtattcacatgaactgccgcacgatattgtgtcgcagtaatttcactcttaatattttcaataacagaaagatactcctgcgtattcattagcacacacatcgcctcactttcacatcatttttatcattatttttttctcttaatatgctaatatgctcttctaaaaagacaatcgcactcttgttatctgctgctgatattatcttaacttacctactaaaacttatcaatccaaatttatattttctctttttttacctcaattcacaattcgataatactctttcgcagtcaccccatacacaatcgcatagaataccgcaaacaccaccacactcacagccgtacattctgcaaacagcgtttcatttgccagattcagcaccgccagcagtttagtcataacaggaaatgcaactgccacatgcaagattgcaacgccaagtggcaagaagaacacgcttaacacctgactatgaattgcttttttgacttctcgtttactcattcctactttttgcataatcttaaagcgttctttatcgtcatagccttctgaaatctgtttataataaataatcaacaccgttgcaatcacaaacatcattccaagatagattccaataaagaagaatgaaccatacaaactatagaaagacttttcacttaaaatccggctttcaaaattaatgttggtattttctccgaattttatctgcattgcttctaaggcttgtttgcaggattttttatcaccttttaaatcaaatccaatcgaataagaaacatctgtcatcgcttttgcagattcttcttcctgtccattttttaatgccagttcttttgtcgcttcggaaaactggcgtatctgttccaactttggaagaatcacataaaatgttccataagtaccggctttatttttgggttctgctttcagcgtttttaattctttctggatttgataagttgttccatttatcgtaatctgagatgcaccataagttctatctgtgcaatataataatgcctcatcttcatttaaagaaacattctggtgttccatctgattatattcatccaccggaattaaagtcatcccacaaattccaaaaacggaaaaatcagatgccggtcttaaggtaaaggaagttccttttgattctgccataagaactgccccatgataggtaatctcagaagtttctgtcacacctgctttttctgcttcatcctttattatctgtcttacctgttgttccgtctcttcatttgttgaaagaatctcaacctttgccggacttggaaatcttacggaaagaatatcattcattcccatatataaggatactgtcatggaaattagtacaagcaccatcgtacttaaaatacagatatttgcaagtccgactgcgttttgtttcattcgataaatcattcccgaaactgccgtaaaatgatttgccttgtaataatatctcttatttctgcgaagcaatttcaaaaatgcaatgcttcctgcggtaaacagcgcatacgttccaataatgacaagaattgccgctacaaaaaacactccaagtgccgcaagcgggtcttttgtggtaagcgccagataatatcctgccgagagggttgccactccaaacagtgccatcagccattttgtctttggttctcgttctcctgcatttcctccatgaagaagttccaccggattagacagacgaatctgaatgatattatagaaataagtcagtaaaaagattgcaccaaataccacaagagtatccactaatgccggctttgaaaatgcaatgtttaagcttgcatttcgatgcagaatttttaaaaacagcagatacatcaagcgattaaacagactgcccagtccaattccacctaaaatactgataccgccaatcaacagactttcaattcccatcatttttgcaatgtgaaattttcccattccaagaatgttatagacaccgatttctttttttcttcgcttaattaaaaagctgtttgtataaaataaaaagataacggagaaaatcaccataattccggctgcatactgaaggcagacctgcatcgttccttctcctgcgatttcttttattctgcccaaagtatcaatcataaaaaacatcataatacttaaaatcgcagttagcatatagggcacgtaagttctacgattattttttaagttcgttactgccagacgaagatagagtctcaatgtatttcaccccctgttgtaagtaccgtaagcgttgccgaaatcttatggtacatctcttcatttgtcatatttccacgatacagctgatgaaagacttcaccatctttgataaataacactcgacttgcactgctcgctgctttcacgctgtgcgttaccatgacgatcgtctgaccatccatgttaattgtatgaaataaatgcatcaggctgtctgctgccttagaatccaatgctcccgagggttcatccgctaaaatcaactgcggttttgtgattaacgcacgtgcaatcgcagctctctgtttctgtccgccagatacttcatagggatatttttccaacaacattgtaattccaagtttctctgctatcgtagcaagccgtctttccatttcctgatacttctttccggaaagcaccagtggaagaaaaatattatctttcaaagaaaacgtatctaacaaattaaaatcctgaaaaacaaagcccagattttctctgcgaaaagctgagatttctttctcacgaagccctcccaaatcacttccttttaaataaacctttccctgcgtcggcttatccagtgccgctaaaatatttaacagcgtcgtttttccagaaccggactctcccataattgctacatattctccctcttccacagaaaacgttacattttttagtgcttctacctgattctttccaaatcgggtggtatatattttcttcacattctttacatccagtaatgccattttttctcatcctctcttgttttgttcgtctttatttctttaccttacaatgcttattataaaaaaagagaaaatgtattaccattgaatcaggttacattttctctttgaatcttacattgttgtaaggttaaaatttcactgtaaaactaaattttttattcttcataattttgtcatacacattaaaatagatcaatacttttttaatttgaccatacatcaccaaattagtataataaatttatagaaaataaacatccaaaagggggatttttatgaaaaatcgcatcgttttacttactctatgctgtgtatctttattatgtattggataccctctatctaagaaaatttcttctccttcaaaatataaaacggttcaagtatctgaaaccgacaacacaaaaacttccgctgtcaaccatacacaggaggatacaccaaaaagctccgtatcgaaagacaaaaatacttctgagtccacgacagcgccagaatccactgattctattgattcttcagaaaccaataataccgtaaacaataatgattccactgctccttccgctgcagaatcattgaataattccggcaatattgccaatacagaaacttacgataactccaatataacattagaatcagagcaggaaaatcagccagtcaatattgaaactgccgacgatacaacccaaaccgaccccgttgaagaaaaccaaaataatccacttcaaacagtacaggcttatgttttatccgtagatggcactacgatgtatgtagatttagaaaatccaggagcaagaacttatcctggagagggcgaagaacgccaaactgcttttgatatttcaaatgcagaacaaattcaaacagaaatcagtgacgtttatcctgcaagcaatcattttatttgttcctgtgtttctgttgaaatcgaatattatacagaaaatggagttaatattgcgaccaaattgacctctaacggtcaggaaattgcaccactttactttaaagaataacagtcattagaatctctaaaacctaaaaagagacaaatgcagtggctttttcatcagcccctgtacttgtctcttttctctctcactgaaaattcctctgtgatatatctttatttcttatttttctattccggatgcagttcttctcttgccagtcccaaaaacacctgtgttcccacacccactttggattctatccgaatctgatgccgtaaccgtcccatcactttcttacaaagatacagcccgattccggtagattttttatctgccctgccgttatatccggtaaagccccgctcaaacactcgtggcaaatcttcttcccagattccaattccattatcctcaatcacaagccataactgattggattcctgttttgtaaaaatttgaatcgttccacctttttcagtgtattttaatgcattggataaaatctgttcgattacgaaacacagccattttttatctgtaatcacattctgattcaccgcctgatattctaaccgaatcttttttaagataaacatctgggaatatttgcgaatacttgcccgaattaaatcatcaagcggataatgctcaaatttcaaatccgaagccatatcttccattctaagatacgtcagcaccatttccacatactgttcaatccgaaacaattccgcttttaattcccgtagttttttctcttctggatactcctcttccatcgtttgtaacagcatccgcattgcagatattggtgtcttaatctggtgcacccacatcccataataatcctgcatttcctgtctgaaaatcaattcttcggattttaattttcttcggatttcttctaatttatcaagcaaatcctgataatcattttcaattaaagtatccggttccggcaaatccagaagcgcatcctgcatatttttctctactaaaacaagctctttatgcctcttataaaactcgcaaaaatcaatgaaaaataaaattccagccagtacaagaaccagcaaaaaaccataattcaacgcatcagatggaagattatagaggaaaaatacaaatttcaaaagtgccagcgttattatataaagcaaaatttcccttgcccgctcttttaaaaatcctgcaaatattctcattttgccaccatatatccgattccttttttggtctgaatcacttcttttagaccaatttgttccagttttttacgaagccttgtcatattgacggtcaatgtattatcatcgataaattcgtcactttcccaaagtcttgtaatcagtgcatcccttgatacaatcttcccggcatgttctaacagcatctgaaacagacgaaattcattttttgttaattccattttattctgctcatactcaattgttgcatcagcaagatttaaatatgccccatgccattgcatcacatcgacactgccctgaaattcatacgtccgtctgagcactgcctgtacttttgccgtcaccacatttaaatcaaacggtttttcaataaattcatctccacccatgttcattgccattacaatattcatgctctcgttagccgaagaaatgaacagaaccggcaccttcgatacttttctgatttcctgacaccagtgaaatccattgaaaaatggaagaaccaaatctaacagtacaagctgtggctcaaattttaaaaacgtatccatcacatttttaaaatccgtcacaccctccacctgataatcccatttttcaaagtgtgtttttagcccatctgcaattacaacatcgtcttctacgattaatattttatacataatgtcctcatttattataattcaaacgcttccatatcatccggcacatagagatttccatgataataggcttttccttcttccgtataaagtgccttccttgctttgatatttttatcttcggtatgatataaaatcagattttccacccctaatttttctgccagctcacaggcatcttttacggtagagtgatttttttcatacggatggaaggtatctcgctgtccatacaggcaaaatgcttcatgaagcagccatttactttgtcttgcgtatttttcttcccaatcgcagtatggttcatctccacaacaggttaacttctgtccttcttctaattccatgctaaatccaaactgttttgctttagtagaatgaatatcaaaaaatgtcactttctttccaatgatttctttttcctctccatcggaaaccacaaccagatgtactctctttccaataaaatcggtctgttttttctggagcagtttttcagcaagttcctgaattaaagaaatcacttcttcatgtccgtaaatataagcatcaccttcataagcacctttctgcatattttggcagataatacgggtcatccatacaattcccaaaatatggtcgatatgtttatgagtcacaaaaatatgatgaatgtctgagatagaaatatccgcatcttttaagcgttttaaaatttcgcttccaccgcctccatcaactaataaatattgcttctcattttcaattacaaaacaggtattataaacttctgttactaatgcatttcctgttccaagcattgttaatttcatttttttcttcctttctgttttatctgtttaactttgttgttttaattcccgatgtaccttttttcttacaaaatagaagcaaactgcctgcatcaaaatcgtcaatgtccaagacgccggatacgacacaaataaaatctttaaggaacgatgagccgggaaaactccaaaaatccacacaattcttgttccaactgttccgataatcgataaaatcattggcactgccgaagctcccattcctcgaagcgcacccggaaataaatccatcactccacacaaaaagtatgtcaccgtagtcagtgctaaaatttccagaccacagcgaataacttccggatcttctgtataaatctttaagatttcaccaccaaatgcataggaaccacatcccagtacaagtgaaacacctacacttaaaataatacagtctatcattactcgatccattcgttttggcttatttacaccataattctgacttgtaaaactcatacacgcctgtgtcaccgcattgattgacgcatataaaaatcccagaatattatttgccgccgtatatccggccatcgctgttgaaccaaatgagtttacggaagactgcaaaagtgcattggaaaaattaatgaccgtactttgcacccctgcaggaattccaacctgaaaaatctgtttcagatactcttttttcattcttaattttgaaaaacgaagctgataacttccttctgttttataaaggcaccacagcactaaaacgcaagaaatcagctgtgaaatcactgtcgcaatcgcaacacctgccactcccatgtcgaatacaatgactaaaatcatgttaagaattgcattggtaacccctgaaataatcaaaaacatcaacggacgtttggtatctccaacagctcttaaaatagctgctccatagttataaagcatgaaaaatggcatacctaagaaatagattttcatatacagactcgactggtctatgacatccgccggtgtccccatcagttccagcgcccaccttgaaaaaagcagtccgactatcgccattgcaattccactaatcaacgccaacaatatcgaagtatgtactgtttctgacatttctttttgtcgccctgaggcataaaaacgtgcagccaacacatttgccccaagtgatactccaataaataaattcgtaaacacattaatcaatgccgtcgttgaaccgaccgccgcaagggcggaacttccactaaaccttcctaccacaacaatatccaccgcattgaacatcaactgtaaaattccggaaagcataagtggaagagaaaacgaaatcaatttgtccataatcgagccattgcacatatcaatttcatatttattttgtttcatttttatctccatctcccgtcttttttttacttctctttatcagtatactatacaaaaaattgcaatacaatggagaaaaaatcaaaaaatcaggtaggaaaattcctgcctgattctttgactacttattcaatttaatcacaatatctccgtcatctgcctgtaatttcagattgccatcttttccatttctttgataactgctttcatccacatcttcttcatgaagctttccttcaagaaaatccggtacctcaatatcgccaaaacctgtagatgcatcaaatccaagtgttaaaagctgttctttttttgcttcaatatcaatatctccaaagctgctggaaatggaattttcaccagtaaactcactatcttttgcgacgaaatcaccatcggaaagttcaaagttacaagcttttatcttagaatcatacgttttcacatcaccaaaagaagcggaaacggtgacatcttttaaagtactattcttaataaaaatctctccatcatctgatgaaatctttccactttcaaagcaactgctattaatcaggatatcaccaaatgaactgtttatatttgcagactgaaatcttgcatccgttggaacatataatgttacaacattttcatccgtcgtaaagtctttgtcttttgacaggaatgctgtaagaaatccaatatctatatgtgtataagaattggagtctgaatcttctttaagcgtaagaattttatttttcacatcataagaaaccggttctttttcctttgaatctgaagtcgtataactgatataatacgaatcatcatcagaagatacaatctgcaagtttaaagaagaaagatccacgtttaatgtgctataatcatctatctttgttttttctaatccataagttgaatcttcttttgttgccgaacctttccattggtttaaatcagcggcaagcacataattttttcctccgttcaaaaatccaactgcaaagagaagtgctcctgccacaacgcatcccgcacctgctgcaagacaatttttaatccatcttttcatgaatccttcctccttttctaaatctctttgaacgtcctgaaacccattttgccaatttcacgaataataatccaatcccttttgcaagcgcaacaccaagaataatgctaagtattccaagaccaaccacgaaaagtccgcttccacttatgattgcaaatcctggtacggaaaacggaattgctaaaattccccggataaatagttttgccccgactaaaaagaaacaaaatgcaaaaataaaaatacatagtactatgactccaagacaaattaccaatgataatacgactgcaaggaaagcaattgcaagcggtgcaccaatcggtgccgcacaaattgcaaggcaggctatccaaaagagactccatttcgatgactttttggttgtttcggattccgacacctgctcctctaacttcctatccagaagattagaaatcaagtctcttgctgcttcttttggagttccaagttcgttcattaactcctttgcgccctcttcgtctgtctcttcaaaatattctgtgaaatactccatcgcatcttcataatcctgcgaagaaagttttttcaaatatttttgtaactgttttaaatattcttctttactcaacttcgaatcctcccctctataattccgtcaattgtatcgcaataggcaatccactcatggctaagatattcgatttgctcttttccactttcggtaatcgaataatactttcgttttcttccctgaaactcctgtgaatacgtggtaagaaatcctgccttttcaagttttttcaaaatcggataaagcgttgattccttaatatccgccaccagtttaattgtctgactgatttcgtatccataagagtcctgagtttccacaattgtcagaatcagatattcaatcaataaagcagaaaccggaaaatacatgcaatcatctccttttttaatatgtaaaatatttatatatataaattttatatatagtatagtgccagaacatcgtattgtcaatatatatgtaaaaattttatatatatattctttcccaaacaaaaatacaggattccagctcactcatgagccagaatcccatactctttcggtaatttcatttctttatgctgatataaaattttttccaattcataaatcgcaggtgtcagaaatttatttttatgatacaccaacttaaatttgcggttccattcctgtttttcatcataaaacacccgaattttttcatgtgccagctcatgtgttaaaagacgaagcgacataacagaaagcactttattccaaatcactgcattgataatcgtacgtggacaatttgcctcccacgttaccttgattgaaatgtgatgccgtttcacatagtcctcaaaaagctgtcttgttccgcttccctgctcacgcattgcaaagcactgaccatttaattctgaatttgaaatttgaattttttcaaaaaatggatgccggcttccacatccaagtaccagacaatcctcaataatcggaatcacaaccaaatccggcgactgaatttctccttccacgactgccgcatcgagttcagatttcaataatttctcttcaatttcatgcgtattgctgacaaaagaatacacctcaagccccgtcagactctgttctaattctccaatcaaagttggcgcaaggcaagttcccactgttaaagtcgttcctagctgaaatcgctcattttgtccctgacttagcattagttcctctaactgttcaaactgactgaccaaatctctggcatgagaaagtaatagttttccacgctctgtcaagtaaagtttctttccaaggcgttcaaacaacagcccatgataatgctgttccatttcacgaattgcctgactgacggtcggctgtgaaagataaagatgttttgccgccgcactcatcgttccatactctgcaacagccaaaaaaatcgtaaggtatcgaatcgtcattgtttttatcattcccttttatctataggtaaaacctatcatttttataaaataatatcatttttcaaatacatcaacaagtgttatattatagttattaaaactggtacattgaatattaagcagctgctatatttacgctgtactggtacataaaaagctcaaggaggaataaaatgtcagcattaactgtcagcaaagaagaagaaaaacgtttaaaaggacttggcttcttaaataacaaaggaaccgataacttttctgcacgggttatcactgtaaatggaaaaatttctgctgctcaggctcagtgtttaacagaagccgcagaaaaattcggaaatggagtgcttaccttcactacccgccagactgtagaaattcagggcatcccttatgataaagtagaagcatttcaggctcatcttgcaaaagaaggcttaaccgttggcggaaccggtccacgtgttcgtcctgtcgtatcctgtaaaggaaccacctgccattatggtctgttagattctttcgcaatttccgaggaaattcacaaacgtttttatgagggatatcatgaagtaaaacttcctcataaatttaaaattgccgttggcggatgtcctaataattgtgtaaaaccagatttaaatgaccttggaatcattggtcagagagttccaaactttgataaagctctttgtaaaggctgtaaaaaatgtgccatcgaagcagtatgtccgtccggtgccgctaaagttgttgacggtgtcttaaacattgataaaaaggtctgtatccactgtggtcgctgtgttggaaactgccattttgacagcattaaagatggtacttacggatttaaaatttacattggcggacgctggggaaaacagatttcacagggtcgtgccttaaataaagtctttacttccaaagaagaagcaatggatatcattgaaaagaccatcttattcttccgcgaaaacggaaaaccgggagaacgttttgcactgacagtagaccgtcttggatttgagaatgtagaaaatgaaattttaaacggagacatcttaagcagaaaagaagaaattttaaaacgtgaactgtaaaaaatcccccgaggttgttaccaaaaacaacccagggggattttttatgctaaatctattaatttaattatgctaagtattcttttaatgttgctcttactgcaccaacacctgcaatctcttttacaaagatttcttcaatcagttcgccgataccagctttgtagaggtcaattccgaagatgttttcattagaaagaatggatttaagctgtccgttgtagctttccggtttgccaaattcgattccttttaattctgcttttaattcatccagcattgggtctgcggaaagttcaaacgcttctccattgtcatcaagaccaagaagatatcggcaccatccagcgattgccagcgggattgcttttaatttctttgcatctccgtatttttccacataagatttgatagtttctccgtaacggattccaactttctgagaagtatctgttgcaatacgctgtggagtatcaggcataaatggattcggaatacgagtgttgataacttcgtctacgaactctgccggagaaaggatacccgggtctgtaacaaccggcataccttctacaggaccgatttcatgaaccaatttgtttaactgttcgtctttcatttcgtctgcaattaaagtatatcctaatacacatccgtaagtagccagtgctgtatgcagtggatttaagcaggttgtaactttcatacgttctactttgtttacagtgtcacggtctgtcatgtaaacacctgctttttcaagagccggtctgccattcgggaaacggtcttcaattaccagatactgcggtccttctgcatttacaaatggtgcaatataagttctcttagaagtaataaccggtgcaatgtcttcgattccaagttcctctaaagatttgcatacagattctgccggtcttggtgtgattttatcaatcatagaccatgggaaagatacctgtgcttcatcggagatataagctacgaattcatcttctacgaatccttttttgttccattcttctgccattgtaagaatagaatttctcagtttttctccattgtgagagcagttatccatagaaacaacagctaacggagcttttcctgctttgaaacgttcatgaagcagtgcgcatacaacagccattgcagaacctgctttttccggaccattgtcgatatcgctctggatgaatgggaaataagttccatctgcgccttttaatgcataacctttttctgtgatagtaaaggaaatcatctgaaggtctttattctggaagatttcttttaaacgattccactcagcctctacattagactgtgctttgattgcctctgttaaagaagcgattacttttttatctgtacttccgtctgcttttaaggtaacacccagaaccagattgtcataaggagcgtagattttgtccactacatcgaagtcaaatgtctctacgcaggtaatacctttgtccatagctccgttggaaattaaagtatctgcgattccaccaatgaagatacggaaaatatttccgattccgaaatgtacccaagctggggatttctttgtttcttcttttactttttcaatatcataggatggaagcacaacgcctgctgcttcccagcttttcttatctttaataccgtctaatgtcagcttcatcttcattttcacctttctattcttatttactataattatttattttcgctttttgcttctttttcgattgcttcccataatccgcaaaggtaagctgcaccaagtgctctgtcatacagaccgtatcctggcattgctttttcgccccaaatcattcttccatggtctggacggattggtccttcaaatcctgtttcatataaagctttcataactgcatgcatgtcaaatgttccgtcagagcttaaatgagcactttcttcaaaatctctcattccatcattaaaacgaaggtttctgatgtgcgcgaaatgaattcttccttttaacatcttaacagttgcaactaaatcgttgtttaagtttgttccataagaacccatgcagaatgtaacaccgttgtgtttatttggcaccatttcaatcagacgttttaattttgcctgagaagaaatgatacgtggaagtccaaatacgctccatgatgggtcatccggatgaattgccatgttgatgtcgtatttgtcacaaaccggcatgattgcttccaggaagtatttcaggttttcaaacagtttttcttcatcaatatctttgtaaagttcaaacagctcttttactttttccatacgttccggttcccaacccggcattacagttccgttcatattgtttttgatagcgtcgaacattttttcaggatccatgctgtcgattacatcctgattatatgcaagaacggttgttccatcttctctcatacggtcaagttctgttcttgtccagtcaaataccggcatgaagttgtaacataccatgtgaatatctgctttaccaaggttctctaatgttttgatgtatgcttcgatgtctttgtctctgtccggaccgccggttttgattgcatcacttacgttaacactttcgatacctgcgaggaaaagtcctgcatcttcaacatcttttttcagtgcaaggatttcatccaattcccatacctctcccggcattttgttatacagtgtggaaataattccttttacataacagctctgacgaatctgctgtaatgtaactgtatcatactcttttccataccaacgcattgtcatttccataataaacattctccttatcattttgatttcttattttatgttttcagtttatgtgtatctttttctcgtatactagtatggtagtataaactcaaaattttttcaattcacattttcactatatatttttttatttttctgtgtattttgtacaagtttttttattttcagtttaaaccattgactttaagtctcgattttcagtatactagtatgtaagctgttaaaaggataacaaactctaattttcatctggtaaaaaacagtttcatagcgtataattagaaattagggtatcatttctactattagcaaagagagggtattttatatgataatacttaacagaaattcttctgaaacagcaagatcctatgccatgcgggttcttttatataacattatccacgttgaacttcagcccggaagtgcagtcagtgaaaatgaactttcttctgccctttccctttcaagaaccccgattcgtgaagctttaatcgaattaaaccgtattggacttgtcgaaattcttccacaaagaggaagttatatttctaaaattaattatgcaattgtcgaagaatcccgttttgtacgtcttgttatggaaacagcagttatcaaacttgcctgtgagtctattacagatgactacctgcttgcactgaaacaaaacattgaacagcagaaagcctgccagactaccaaagacggagaccgttttcttgaaatcgacaatgaatttcatcgtcttatttttgaatgtgcaggcaaaatgtggtcctatcattttgtagaagaacagatggttcactttgaccggcttcgtgcacttgcagcaaaatccggatatgcgaaatcaacgattccggatcacgaagatattttatatgcattaaaacgaaaagatgctgaaatggcagaaatttttatgacccgacatttgacccgatatcagacagaaaaaacggaaattatgaaacaatatccggaatatttcacgaaataaaaaacagaggtgtatcgtttttaagcaatacacctctgttttattttttatctattaagtttttggcacatcaacaatgctcaagatatgacgcagtatgatttcttcatattatttcataattggttctaacgctttagctaatttctccttctcagcctctgcttcttccagattctttccaagtgttgtgtaataaatcttaatcttcggttctgttccggatggacgaacaacaacagtttcaccgttatcaagtttgtaaattaaaacatttgcagatggaagtcctgtttcttccggttttgtatagtctgttactttgacaatctgatgtccggcaatttctgtcagtggtttgtcacgaagtccctgcattaatgcagacatcttgtccattccactcaagcccgggaattcaaaactgtctactttatttaagtaacgaccatactgtgcgtagatttcttccattctctgttttaaggaacttccgatacttctgtagtatgcagccatttcacaaatcagcatagaaccgattacagcatctttatcacgtacatacggtcctgcaagatatccataactctcttcaaatccaaagataaagcggtctacttcaccagcttcttcaagctgtgcaatctggtcaccaatccatttaaatcctgtcagtacgcttctgagttctactccgtaatgctctgctactgcatccgcaagtggtgtggaaacgatagattttactgctaccggattcttcggcattgtgcctttttcgatacgacctgcgcagatatagtctaaaagcagtacaccaacttcatttcctgttaccagttcataggagccatccgggcatttcattgcaataccaacacggtctgcatccgggtcagttgcaagcattaagtctgcacctgtttcttttgccagatttaatcctaattccagagccgcaaaaatttccggattcggataactgcaggttgtgaagtatccatttggatattcctgttccggaacgattgtgatatctgtaattccgatatcttttaatacctgagtaaccggcacaagaccggaaccgtttaatgggctgtaaaccagtttaagacctgctgttttgcaaagacccggacgaacctgacgagattcgattgcttcgtaaagtgcttttttgcagtcatctcctacaaaacgaatcagtccttcttccacaccttctgcaaaggacatatatttggcacctgttaatacatctgttttctgaatctcttcatatacaattgcagctgcgtcatctgtcatctggcatccgtccggaccataagctttatatccgttatattttgccgggttgtgagaagcggttaccataatacctgcgttacattcatagtaacgtgttgcaaaggaaagtgccggtaccggcattaaagcgtcataaattctgactttaattccatttgcagccagtacacctgctgcattttttgcaaatacgtcactctttaaacgactgtcataactgattgccacagtctgatttccgccctgtgtttttacccagtttgcaagaccctgtgttgcctgacgtaccacataaatgttcatgcggtttgttcctgctccaagtacaccacgaagtcctgcagttccaaattttaatgctacagcaaaacggtctttgatttcttcatcgattcctttaatttttgataattccggattcaaatccgcatcttcaaggtctgctgccagccagcgttcatattcttcttgatacatttttaaccactcctactattctattttttatgtatgtataaaacgtaactatactataccatatttttggtaaaaccgcaataaagccggaggactttgcacctatttttgtgctcttttttcgacaaaatatacaatgattattggttttctattttttctcaaacttttaagttctccccaaaaaccctaaaaaaataagttgcttctacagactgatgcagaccctctttctggcggttttcaatcatttgatacactcgttcatgtgcttcatacaattcttctttccttccggactctaacattccctttactgattcatatctcgtagaatatgtgagaacgcgcataattgcgtttattttagaaatcatagagttatgtcccatatctgtgattgcatcatgaaactcgttatctgcctcaaatacagcatctacatccggatgttctaccataattgtttcttttaaatgaatcattctttctttcagctgtgcaatctcttcttcactgcatttttcaacagcaagacgcatcacacctgtcgctaccattgctcttaattcatgcagttcctgttcattttgctgattcaagataattccataaatcattgggtcaatcagactttctgagaagccattacatacaaaagttccttctgctcttttaatttctaataccccaatataaaccagaatctttattgcttcacgtatggaattgcgtgccactcctagctgctctgacagctccatttctgtaggaatcttatctcccggttttaattccccactcagcatcgcctgtgtaagacggtcaattacacgctgtacaactgatgaccggttaattttttttaagtattcaggcatcgctcatactcctttcctcgtttttgtgtaacattggatgttgttcattccattatacttggtacgattcgataaaacaactaatttattcgtgatgtacaccaaaatttttgatattcacatcatactttaatcgaataacagaccagatccaacaaaaatccggtcgtttgcaagcaaaatcgcctgcaaatgccggatttttaatatctttttattcctcatcagccctaaaatttgtttaggggagattttttcgaaagttcacaaccatggcatccctgccatggcaaatctctttttgttttttatgttctaatttactatcttaatgcaccatcggaaccaaagttatatttctttcctccaatagtctgccagccggttctcattgctccgtcatttgctccgccaaagtaatatttctttcctccaatggtctgccagccggtcttcattgctccgtcatttgctccgccaagataatatttctttcctccaatggtctgccagccggtcttcattgctccgtcatttgctccgccaagatagtaccatttgttataaactttctgccaaccggtcttcatcgctccatcattttcatgtccgagccaataatatttgccatagatcttttgccatccggtcttcatcgctccatcattggagtgtcctaaccagtaatacttaccatatactttctgccaacaggttctcatcgctccatcacttgccaaccagtaatatttaccataaactttctgccagtaagttttcatcacaccgtcattaccaaaccagtagtaggaatcatagatataattccagtaccgagccatatctccatattcatcaaaataatgagcttgatcataaatatcccaataccagtaatttgtcatcggaattccagaatcatctaagatgtaagtatgattgattccatctatttcaatttcaagcattttataggacatgtattccgatggaacttcaagcccttcaattgggaacccttcatcattatcatagtctccctctgccatataataatgataactgtcttctcctgtcattccatccgaccatataagatagtatcctccatccggaattcctgccgatcgatcagagtaatccgcaatcagacgatatcttaaaggaatctctccgaattcatattcatatctgagtcctaccatgtatgttccggtgtccagcgtatccggcactgcattcggagcatcactattataacatctccagcgcttgtcatttgctgtataaacccatttgctttcaagcttattcttcgtatgtgcattatcataattacgatagattactttttgaatttctccactgtaaaaattagttacaatttcctgtgtccactcatcgccttgcaccacttcaccggtcgacatttcatcggaccagccagcctccacagcggcggctgctaccggtgcaggtacaaccgaagtgacccccaatccaagtgctaaagcaactgccaatccccctaatctttttctcttcataacgtttcctcctctcggattattagtacttatattgtactatattcttcgaggttttccaacgttttttctgaaaatttcttaaagctttttgattttaacaattattttcattaagctttttttctgtcgcacgaatccgaatataataactaatgcaaagtaacaatgcagctccactccaggcagcaatctcggcaaaaaagattccattttgaccgataaaaatcggaagaatcaaagccgcaccaattcgcatcaagaactccgcaaatccacttaacattggaagcaaggtatctccaagtccctgaagtgccgaacgatacacgtataaaaaatataacacccacagcatcgccgccataatagaaagataatgaaacgcaatctcaagtaccgcttcgatctgctgttgctctccggagaggaacaaggataagattggtttcccaaataaaaacattgcaacggaaatcacgattgaagtcgcaagcgaaatcaaaagactgacccgaactccacttttaattcgatcaaattgctttgctcctaaattttgtccgacataagttacgattgcataaccataagaaatcgctgccatctcaagcaagccatacaacttattagtcgcagtaaatccggcaacaaataagaaaccatagccgtttattacatactgaacaaccaagcctcccactccgataatgatattttgaaaaactaccggaattcccagttgtagtaaatttaaatccagttttgcctcatgctcaaaatccgattttgctaactgtaccagcttaatttgttttaaaattgcaaaacaatagattgcagaaaacagctgtgcaataattgttgcgattgctgctccggcaattccccagccaaacacagcaacaaacaataaatccagtacaatgttgataagcgatgcaatcagcattgccgtcaatggtgctttactgtttccaattgcccgcagctcacaggcaaacatattatatgccgtcgtaaatggaattccacaaaagataattcgcagataaagcagcgccattccaatgatgttttgcggggtatgcagtccggtcaatgccgctgaagccaacagctggctcaaagcaaaaaccaaaacggcagtaatcgcagttaaacgataactatgcgcaattacttttcttaaagcgactccattgcctgccccgtaatgctgcgaaatcaagattgaaaatccctgcgtaattcctgttgaaatgcctgtcacaatccacattaaaaaatcaactgagccaagcgctgccaaagcctctacacctgcaacctgaccgacaatcatagtatctaccatagtataaagctgctggcaaatgttcccaagcattaacggaagcgcaaaaaagaagattaattttgcggcatttcccgaagtcatattttgcgtctgtgccttcataacatctcataaatcctttcaaaaaatacgttttttatcctttcagatattaactctattctaccatattgccctgtaaaacggaagaaaagggactgaaattcactccctttttttatgtgtttttttctccggaagcaccaacattgcaagcgctgctaatacgataattaaccctgtaatggaaagcacagttgggatttctccaaaaaagcaaataccaaataccattgccgcaaccggttcacatgagcacaaaatggatgccttacctgcatccatatggtccagtgccactgtgtaaaatgcatatggagccaccgcaacacataaagaatgcaccaacataaaccccgaatgcggtaacggattttgcataatatactgcgccacatcgccccattttgcaaacggaagcaggattactgcaattgaaaggatactataaaaagtaatcgtaagcgccggatacccacgtctcatcccaactttagaaaagatgctgtacatcgcataaaaaatggcgccgacacttccgactaaaattccaatccaactccaatgcatactctcatttgtttcaaaaatcccacttgtcaacacgcagccacaaattgctaaaaaaatacttaatacttttcttcgcgtaatcgcttcatgaaagagaaaaaatgcaacaatcatgaccacaatcggagaaagtgcaagcagcaccgctgcaagcgaaagcgacaactcattgatagcaaaattgtaacatacattcacaccaagtgacccaagaagccctgctccaataaaaatccagcaatcttttaaatgaattttaaaatactccggatgcgaatacgcaagccagattccaagcaacagtactgcaacaatcaatctcgaagccacaattgtggtgttattcatatctccgctcaatttgcgcacaaaaattccggcagaaccaaaaccgattccggtaataatcggcataaaaccatataattttttcatctttttaccaactttactctcattaacaatattttttcagaatttcatgcatcttttcaaactgctcttccatctcttttaccagacgaaactgcgttcttgcgcgcaccagattgtgctccggatatgatgttttaaagtatacatcaccctgaaggaaatccgcaagaaaacgcattccacactctaaagtcatcaatctggctccccatggaaggctctcaatttctgccggagtcagcacatcttttgccatctccagatatcccttcacatagatttcataaaggtcgatatcaaagtgtactttgtccaaatctttttcatcttcttctgcggtagaggcaccaaaacgaatggaatcgccaaagtcgttacacgcaagccccggcataatcgtatccagatcaatgatacataagccctgatccgtatctttatcaaacaaaatattattcaattttgtatcattatgtgtcacacgaagcggtaagactcccttttctaactgatccatcaaaacattacaatctgctttacgagaaagcacaaattcaatctccggatggcataatttggcgcgatttttcacatcttttcgctgcgcatcttcaaaatcacgaaaacgctttgcagtgtcatgaaactgcggaatcgtctcataaagactgtctgctggataatctcccagttgctttaagaaatgtccaaaactaagtgcagattgataaaactgctccggacgctccacctgctgatagcacacggaattcggcacataatgcagacaacgccatggctgtcccttctcatcctcaaaataagtatcgccactctttgtcttaatataagataaggattctctgtctaaatcgccaccgtcctgacgaataatattacgcaaatattccgtcactccaaaaatattttccatcacctgatctggatttttaaagacgttaatgttaattcgctgcaatacaaagagcggcacatcatttccattttcatccggcaaatagactgcataggtctcattaatatgaccttctccaaatggctttacatagctgcagcaatcgccaaatccaaacgcataaatcgcatcttccagacttcggctatctgcaccttcgatggttcttctggtagagaaaatcacttctcctgcttccacttttctgcccggctcaatcacacaatgtgcttttactacgctgccaagaccaacatgtgcgccttcttctacaatcgaatcatggtctaccactgcaccgctgttaataagtgctgccattttgattgttgtattcatatttaccactgctctttgcataacaaaacaacccggctctaagcggacactcggactgacgattgcagatggatgtacgattgcaggtacttcatactcctcttcaagcaatttttgagtccaaaataaacgcgtcttgttatttccaaaagctgctaccgctactgaataatctctatgatacagatgataatcgcagcatctgccaatcacatcatcatcctttgcggtatcgtctaaaaataagacttcctcataaccaagtgccaatgcggtttcttttatcattcttccaaaaccgcctgcaccaagaattaataaatttttcattttcctctttccttcttttttatcttgagagcgtacgctccgatttgtattctataaaatttataaacgtaaacctattttatcatctacttctcttttttttcaataatacttattaacacttattgaaaaaaccttgaatttgcccagaaatttccttttgttcgaacttatcctgcaaacacttcttccaaagtctgatatttaaataccggaaaatcgttctcatcataatgtactttcattatcatagcatgacggttcggatcatacaacgggtctcccacaatttcatcataaggtcttgcatgataaacacacaggtctgtcactccatcttctgcttttacaaatgagttatgaccaggtccaaagactcctgctgcataatggatttggtaatgcaatcgaatatcttggacgatatacccacaaggttgctatctctaacagccgaatcatctctgtcacggatacacacacaacattcactgcccgtggcagaaaaccaggtgaccctcgccgtacgattaccctcagtaatgaggagtttatcaggcgcttcctcagtgaagaaatctgctcttcttaactactctgaatctgatactttcctaatgaattataacatgaataatcggtatctcatagataaaaaaggccagataatgattttttctcattacctgacctctctcctagtctatcgcatttaagccacttccccagattacaactccacttttactgtcaagtgcagtaaatgtcatgacatatttcttcccatcttcatcccactgttttaaagcaatccctttatactctgcctcgtcggtctttatggtaatattataatctccacttaattcccaagttccctcaagagccccacttatcgtattgtttttattcaataccagttcttcagactctttcatatccggagagatatcacgtccgtggttaatatatttatacgttccaacaagctgtttactttccagtttttctgcactttcttcggtatagcggtatggcgcaataaccggccagccttcttcattaaaaaacatctggtgtacacgcacttcatgagtttctccgctattttcaaatcgtgtgtgataaataataaaatattttccggtttcttcctgatacagacaggaattatgacctggtgaaagatagccttttcgatcttctccttcttctccttctttccaggtaaatttataaccacccattaattttgttccgtactgttctgccgttgcatcactaaaggcacttcccgccggacctttacaatctttcatgtcctgtcccatggaatctacataaggaccattcgggttctcggaacgacacacacggatattatagcctccatctgaatctaagcctccaaacgataagaacatataataatatccggtttcttcattatagatgacataaggagcttcaattcttagatgatttcctccaagcagtttttctccatatccgctctctaaaggcattccgctctctgcatccatttcttttacaaagattcctccggaataagagccataaatcatccagagtttcccttctttatcataaaatacaaccgggtctaccacatttgggtctgttgtcgcctgatacagatttccatcttcgtccttctcacttgcactcattccggattttagcataattccctcattgctataaggtccttccacagaatctgaaactgctgttccaagacaggatagcggagagtcccctttgcaattacaataatataatttataacttccatcgtttaattttatgacgtctggagcccaaaacgtattgctctgtgaccactcaaatgcttctttcatttcttttaatacatttggaatcaccgtattattattttttactccctgattgacatacgtccagttcattaaatcctctgtttttgctactgcaagatgtgagccaaaaatataatagcttccatcttctccctctataatcgatgggtcatgaaccgatacttcagaaaattctttttccaccggagtatctgcttttaatttttctttttgtgcgccacaacctgtcattaacatgagagacattgcagcaaacacaattgctattttttttcgtttcataaattaaatccttctcctgtaaaaaaagcccaaatggatatcatctaccttctatccatttgagccttttcttatttttttgctatttccatcggactataggcaatccgaactttaatatcctgattataatttccaaattcacttccgaaaatggtaattccaccgatattttttgcatcttcttcaatttcaaatttaaatcttaccgtgcttttataatccagattaaattgattaattgtaacatctgagattttcaatccatctacaaacgttccctttttattaattacaatcatctttaacaatccatactggttccagtttggaaaccaccagtccggtgtaaagattccctgtacatctccatagtctcccggacttgtccaagtaccgatttttacatcattcaggaaaattgaaatatccgaaggccagtcattattaattcccggtgcctctgaactgatttcaagagaaaccgtaatctggtcaattttggttgcactcggcaacagatttggaatcatatactcaatatagccttttgtaaaccacaaaattccagcattgattctatccggatgagaaaaataacgtgggtcatctacctctccgacaattgccttacttgtagcaagtccacaggtcggatatacattataatccgaataatgtcctactttcacttccgtgttataaatattctggtcttcttcggtttcttcagattctacatcaaccacaatcttatcaactgcaactttacagattttctgatttccatgtcctccgcgttctgtcataacctgaatgattccactttcttccagctttttgatatgactggtcagcgcaccatttgtaattccaagacttgttgcaagttcattcatgttcatctcatggttttcctgaagaagcttgataatattaattctcagttctgaaccaagcgccttgaaaacctccaggccctcgtccaaatttttcacatgcaacatcttataagtcctactttctcagaaataaatacctcgtatcttcaaaatacctttagattggtctaaagtatactataccacgaattttccccaatacgcaagacctaagttgttgattccggtcagcacatacccttttttttgattttcaatatcacagcatgaataaataattccattctgaaaatattcactctctttatccagtgtacagacctttgactgtttcatattgttatcaaattcatcaaatataattaattcccagtcgccttggagcttttccatatccggtttcgataccggctcaaagttctctccctgatatggttctgcaccaaataccggccagtcattgataaaaaacatcggccgtatcatcatataatgaatctgatagctatccctgtcttctgcttcctcataaatacgatttacctttgcaccatcccgtacatgatgcacaaaataataatgttccgactgtgggtcataaaatgggacaccatgccccggtccacgaaatcctccccacttccagtctttttttgctttacccactcttggatttaccgcttcaaactgataactccctgcaagttttatccccattccttcttctacaagtgaatttccatgccagtccagatacggccctgtcacgcacctgcttcttccaacacggatgtcataagtatctccaagccagccataagactgaaacagataaaaataacctgtctcaggcgcataaatgaccgatgccccctccggtccgtcaatcaatgacttttttgcttttcttgagatacagttgccaagctccttcgcatcatttgagagagaaagaccacttgtggcatctaactctttgatataaattccaccaaagaaagaaccatacactagataacacctctcgttatcccagataatatgtgcatcaattgcatttggtgctgtatcatccgtcccccaggtatctgctacaattcctctgttttcaaacggtccaagcggatgtttagaaactgcaagccagattcttgattccgaactgccaaatgcttttgttgctgaataatacatccggtattctccatgtgtatattccacataaggagcccagaaattcacagtctgtggatactctccgttgtctcttccttctttgatggccttttgggaaagcgcaattccttcatattcaaaatgaatcaaatcttttgagcttctgaccggaattccgattttttctgtcagcccatcttccggctgatatacatccgtactataagagtagtatttttctgtcaccgggtcccacatcatagaagggtcatgggaccacagagatgcatttttaaaaacgctgccttcatttaatgttaatattcctgttttcaaaatttctcctctttttaaaaaagggctgttttcagaatatctgaagacaaccctatctctttttcttttcttatccttttacaccggatacagccatagattcaataatgtaacgctggaagaagaagaacaacaacagcgttggaagaatcgaaagcactgacgcagccataatcagaggataatcactgtttaccgcataatatgcattaaaggaacggatgacaacctgtaacgtaaaccattcttcattctgaataaagatggttggtgcaaggtaatcattccagattcccataaaccagagaatcaactgtgtcattaatgcacctttcatcaacggaaggaagatgctccagtacatgcggaagtaactacatccatcgagttttgcagcttctacgatagaatccggaatactggtcagattctgtcttaagaagaaaatgatgcttacatttccgaataatcccggaatgataagtggaagcagactatttgtccatcccatttttgtaaacattacatactgcggaatcataacaactgcaaatggaatcatcatcgttgcaagaagtcctaagaaaataccattttttcctttgaattttaatttactaaaggaaaatgctgcaagggaagaagtgaatgctcccactaccaacaccggtattgcaacagttaaggtatttcttaaacctcttaaaaattccggtttctgcaatacttcagagtattttccaaatttccaagggtccggaataatactaaagtttgcagaaagaatctggttctttgtcataaaagaacttaataccatgtacaaaagcgggaataccattgcaaccgctccgattaaaagcagtaaaaatataatgccatctatcgtttttgctttttttgtttttacttctgaactctgttcatctaattttgccatattcccacctccttactcgattgtcttaacccacttatcctgacccttaaagttaattgctgttacaataaagattaagatagcaagtataaatgccattgcagaaccgtatcccatctgattatttccaaaggatttatcatacatatagaatacaacggttgccgcactgtagtttaatccaccatttggaaccataacaagtacttctacaaatacctggaatcctccaatcaaaccggtaatcaacagatagaatgtaaccggtgataccagtggaagtgtaatgtgacggaataatctccagccgctggctccatcaatttttgctgcttcataatagtctcttggaatactctgtaaaccggacaggtaaaggacgatagaaccaccaagtcctttccataccatgaaaataatcatggatacttttacccagaactggtcacctaaccagtttggtccgtgtataccggataccgctttgataatactgtttaacagaccataatcatagttgaatacccacatccacagaattgcaactgcaactaaggaagatacaaccggtacatagtataaagtacgaagaatcttaattcctctcattttacgattcattccaactgcaatcaacatagccagtgccattccaatcggaataccaagcatgtaaacaatggtatttcctaataccttccagaattttgcatctgtcaataattttgcatagttctgaaatcctacaaaattatctaacatgctgttcataccattccattttgtcatactggcaatcagtgcaaacacaatcgggaatgccatgaaaatacagaaaccaatgaacggcggtgctacaaatgccagtccccagcaatgttctttatatgccgcacggttcattttttgctttgttttcgttttgctcatctcttccgctccttaatctttaaggaagcaaagccggaataatccggtcctgcttgaatttactattctacactctcccatgcttcatccagagatgcctgcatctgaggctgtacctgctcgatgtattcatctactgtcatagagccatttttcacgttatcaagtccttcaaggaaaatgtcgttccattcagcatttggagtataagttgtttcctggaatcttccctcgtatttgtctgttccctgtaaatagttaaagaatacatttacatttgatgggaatgcaagtgttccatcttcaattgctgtcataaattcaccgtcagcaaggtctttcatatttggcaactggatggactgcccaccttcgataccactaagctgtttctgtccggcatcatctgtacacagataagaaaccagttcagttgcttcttctttatttttactgtttgcagatacacagaaaccaactgttccaagccatgtcatggattttccggttgacagtgtcggatatgcacataaatcccagttgaatgggaatgtttctttatccataaatgctgctacgtcccaagtaccacatgcataaaatgcttcctgtcctgcaagccatctctgatatacaccaagagaagcatcctgttctacagtaggagtaattccaagttccagtgtacagtcaacatatttctgaagtgcttctttaaattccggagtgtcaatggttactgttttgtggtcgtcacttaagtagcttgctccgtttgaccatacaaatggctgaagcatgaatgcatttgcaaatccacatccccactggtcgatttctccatcaccatctgtatctttagtcagttttttacaaacttcgatgaactcatcgtatgtatatggattttccgggtccggataatcaagtcctgcttcatcaaataaatctttattgtatgcataagcaaatacggatgcatcttttggaagtgcatataaatcgccacttcctgtcttatctccatcatagcgatagctgtctaaagcttcctgtgctaacattccatctgtgctgattccttttttatccagaatcggctgaaggtcttcaatatatccgttctcaacaaactgttctactgattccggtccaacataaaagatatccggcaaatcccctgctgtcatcatacctgttaatgttttggaatattcgtcctgagttgtaatctgtacatcaatgtttccaattgtatctgcatggtctttcttatactggtcaatcatgcttttgtatacagttgattcatgatcatttgcaaagataaaaatagaaaggtttttctttccgtctgctgtttctgatgaatctttgcttccgccacatcctgctaaaagtgatgtagccattactgctaccagtcctgctgaaactaatttctttaacttcattaagggctcctcctctttcttcgatagactatatcgtacttcgtttctaaagccatactagcacttaattttagatttagcaatagttttttatatttttctaaatattcacatggttttcgcttttttctacaattctgtcattttgtttttgtgcatatttttctaaaatatttagattaggctaaactatatttcttatgcaaatacctcttccattgtctgatattcaaacaccgggaaatcattttcgtcatagcgcactttcattatcatcgcatgacgatttgggtcataaagcgggtctcccacaatctcatcataaggtcttgcatgataaacacaaaggtctgtctctccatcttccgcttttacaaatgaattgtgtcccggtccaaacacaccggcttttacatctgttttcagtaccggatagcgcagttttgtccagcacgctgggtctaacaggtctgcatcctcatcgatagaaagcatacccatgcagtaacattctccggttgcacttgctgagaaagtcatataaatttttccgttatgttttaaaattgccggtccttcatttacccagaaatcaattctttcccagtcataatccggtgttgttaaaagtacctgaacggttgcaagcttgtttggtgtttccatttttgcaatgtacaggtttgaaatctgtttgccaacccctgttttttctgcccagatatagtaataatcccctttatgttcaaatactgtcgcatccagtgaaaatgcatggaaagaaaattcatcttcatttgctgcctgcatcattcctaattcttcccattcatctttcatcgggtcttgtcctttacaatgaagaacgtaaggacgaatttcccagatgtcatctttatcccctgctgcgtagtaaatgtaccatccaccgtctacataatggatttccggagcccaaatatgaatactctgtggtccttcttcatgctttacccaaagtgttttctctttggcctctgcaagtccttttactgtatcggaagaacgaagcacaatcttatcatattccggtacggaagcagtaaaataataagttccatcctgactcttatacacatacggatccgccctctgtaaaatcaatggtttgttgtacttggtttctttatagttatttttgttcattcctttttctccttttagattaatgtaaattaattttatattatttaaatataaatttcaatagtattttagacttttgtaaaatattactgattccaattcggcttttttgtgaatgattttgcggctttttgtttgaattttatattagattattctataatattatacggaaaccaaaacatttaagattttaccgccaaaaatggcagaacggagacgatttttttatgaatctttttacccatgacagcttgctgtctcgatttttctatcttgtaggagatatcatcacccttcattttttatggattttatgcagtcttccaattatcaccattggagcttccactactgctctttattacagttgtatgaaacgtatccgtacgaaagaaggatacccgcttaaaaactttttttcttcttttaaaataaattttaagcaatccacacttatctggattgggctaatgattatcggatttgtattttttacagactttcgaattgccatggcacttgaaaatacactcggtcgtctgatgctggtgacctgttcctgttttcttattccataccttctcatttgcctttatatttttccggtacaggcaaaatttaaaaataccatctacaataatttaaaaaatgctttttttatggccatccgtcattttccattgactctgcttttaattgcaatcgatgccacttttattctgcttttcttttctttcgttccatttattggactggcactttgctgtggagtcggattgcttggatatttaaatgcgaatttatttgtttttatctttcgtaaatatgtacccgatgaattagaacacgacctagaaatctccggtgaacgattttaagaggagccctttttatgaatacaaaattcaaaaagactgctttagaagatgatgcagagatttatcagcacggcacaaaatcagccacaaaagacgatatcaaaaaattgccgcccaaaaaacgtatcgcttacttttgtgactactatctggcaaaatgtcttgtggtccttgcccttatcatctgcatcatccttattatatgcgcaagtatcaatggaaaacaacatacccccgtactttctgtcgcactcatcaatgaagtctacctttcggatacggatgccctttgtgatgagataaaagaaagtcttgaactagatgaagatgccatcgtaaacgtcacttattacaatctcaacgaatatcaaaataacatgtcttatctggctcatctttctgccggaagcgtcgatgtgattctttgctctgaagaattttttactgattctgctccacagggaatgtttgcagatttaagtaccctgctttcaaaagaggaactttctgcttattcctcgcagttaaaagaggcttctattgttgataccgacacagacggaaaaatcatttctaaatctgaacctgctcctatggggattgatgcaggaaattatattatctgtctaactgaaaaaggggacaacccagaaaatgcgaaaaaagcagtttctttctttacgacacacacagactgcctgaacccataaattcaggtagtttgtgtgttttatttttgaaatagacttttccctttataaaatttctggtatggttaaataatatcaattacaatattcctgcttatttcaattaaataaactggccgaagtaaaaggcatgccttctgttaccttaaaacaacgataacgcccgttttaacgatgcattaaatccagaaaaactcgaaggaagctataccttaaatggagagcttaataccagtgttaccagtcctatcgcagatgctgccaatcagttaggaaatggcggtctttctagcgcagacgaagcattaaatttatcaaaaagagataacataaaaaagggacggagtttgtagcttgactaagccacaaaccccgtccctttttagattattctctgtcacgccttctgcttaggtacaaactcaattttgagagccattcccataccatctgctaaccgtttcagtaaattaatagaaggatttctagttccattctcaagcttactaatatctgcctgattaatacccgtacgctcagcaagctccttctgtgtaagattctgagaagttcttgcatctacaatcgctctgataacatccatttctggttgaattgcttcatattcttttttaaattcttcattttctaactgcttagagagcatatcatcaaatgtcctcatctctcatcatcctttctatgaaatcttttctcctgtcttttgcaatctgtatctcctcttttggagttttttgtgtcttttttacaaaaccatttgtcattataattttttcctcacaataaaaaaatacaaaactctggtaatatcacttagaagtattttctaatctctaagaggttttctacgcatccatataagatttcttttaatgcttcttctggttctgtctggtccggaaccatcacaactttacaccctgcacgataggcacttaagactccatttggcgaatcttccactgccatacattcttctggcaaaagtttaagctgcctacaggcatattcataaatatcaggcgatggctttccgtattctaccattgttgcacagataattttatcaaaatatggttctaaaccaatttgttttaagtattttctggcacgttcttcatccgttgccgtagcaatcgcacgtttgacattttttgtttttaaaaattcaagcagttctactgctccttttttcagttcaattccattcttttgaagacattcttccatgatttcttttcgataattacgaattgtagtgtaatccagattctcatcatgaaacatctcttttaaatgttttggcgcatagggtcttccaagagagcgcatactaagtgcctgttcatcactcatctcatatccaaaatgtgccagtgcctttggccagaaaatccggtaatatttctctgtgtcaattaatgttccatccatatcaaaaatgactgcttttatcatactgattttttcattccttctctttttattcttctgttttattcttctgccttcgcatcaacccactctacggtatattcttttccgatttgttctcctacatttttcacatatccttcaatcaggcttttcgcccgttcttttgcctgatttaaaagatttccattctcatttgcagtttcttccatgtgattttgcgcctctgcaagtgcctcggtttcttcttcttttgtgattttagtcataaatccggtatcggtaagaggctctcccatagaatcctcgtctaaatccacactcaaaatctcagcatccggaatggtcacctttaccacgccgtctttgcttggtttggaaacagacaccttgctgacatctaccccaagttctacaattccactgtactcagtccagatttttttatatcctgttccaagccatttaaacaatccgctggcttccgtctctgattttgctacattgtgataatagcattttaaagttgcaagttcacagacggattgaattgctgaaaaatcagcctcttttttttcctctttcttatctgcacacccggtaagacacagcatactgattactaaaagacaaagtattttttttcgtttcattttattttctccattttttatcacactttaccactgaatcgaatacccttcatgttcaagaatcggtgatagcaatgcttcgattacagattccagattttcctgggctgtttcatataatttatctgaatgatttgcctcattcattgcatcttctttacaaagcgtaatgacttcttttaaagaaaggtctggattctttggaatatagctaatcgaattttcatctagcgttgcaatattaatctctatctttggaagaaccggtgtcacagtctttttttcttcattgattttaaatgtcacctcttccatgttaattccgactttcacattggcatcatacgcaatatagcagtctatctcatccggattttcttgattatgtttttctgctacaccgttataaacaaactctgcggtagaaagctggctgatatttatcgcatcttcgagttgagaagatgtaatggtcgtttcttttcctgccttgttcatcacgcccggaagtaccagacctgctcctgctgcaattgccacaatcagaacaagtaagacaagttttttcttcatagtattctcccataattttaaagttttctggtttcctgctattttatcatattttattaaatctggaaatacaatgaaaatgcacaaatgttcttgcaagtcgaatatattttctatataatgatgtttgttgtgactttagatttacaaaggagagaaacatgaacgaaaataaagagttcaagccgtatattccggctgaaaaagtgacacctgaatttacaatcacttctattgtaatgggtatccttcttgcaattgtgttcggtgcagcaaacgcttacctcggattacgtgttggtatgaccgtttctgcatccatcccggctgctgtaatttccatgggtgtaattcgcgttatcatgcgaaaaaactccattttggaaagtaacctggtacagactattggctctgccggagagtctttagccgctggtgctatttttaccctgcctgctttattcttatgggcagcagaaggaaaaatggataaaccaagtattattgaaatcacaattatcgctttaatcggtggtctgcttggtgtgttattcatgattccgcttagaaacgcattaatcgtaaaagaacatggcgtacttccttatccggaaggtactgcgtgtgcagaggtccttttagctggtgaagaaggtggagcaaatgcttctactgtatttgccgggcttggtattgctgccggatttaaattcattatcgatggattaaaactggttccaagtgaagtatctttccgagtaaaaggatatgctggagaaatcggaacacagatttacccggctgttatgagcgttggttacatctgtggaccaagaatttcttcttatatgtttgccggtggtattgtcagctggctggtatttattccagcaattgtactgtttggtaatgatttgactttatatccgggaactgctcctatcggagaaatgtttgcagccggaggcgcaagcgcaatctggggaagttatatccgctacatcggtgccggtgcactggcagcaggcggtatcatcagtttaattaaatcccttcctctgattatccgtacgttccgtgatgcacttaagagcatgtccggggcaaaaggtacaagtaacaaacgtaccgaacaggatttaagcatgaaattcttattgcttgcaatccttgttctgactctgcttgtatggttagtacctgcaattccggtaacgctcgttggtgcgattatcgttgttatctttggtttcttctttgcaactgtttcttcaagaatggttggtcttgtaggaagctcaaataaccctgtttccggtatggcaatcgcaactcttctgattgctactatcatcttaaaaataacaggtgaccagggtgcccatggtatgcagggtgctatcgctatcggttctattatttgtattgtagctgctatcgccggagatgcttctcaggatttaaaaaccggatatttactcggtgcaactcctaagaaacagcagattggtgaaatgattggtgttatcgctgctgcttttgcaatcggtggtgtattatatttattagatgctgcatggggctttggtactgaacagctcggggcacctcaggcaatgttaatgaaaatgatcatcgaaggcgttatggatggaaatcttccatggactcttgtattcattggtgtattcctcgcaatcgcagtagaaatcgtaggaattccggtacttccatttgcaatcggtgtttaccttccggtacagctcaatgcttgtatcatggtaggtggtcttgttcgtcttgtatttgataaaatgaacaaagagcagaaagaaaaagatgcaatcatcagcgacggtatcttatattgttccggtatgattgccggagaaggcttagttggtattttactcgctatctttgctgtatttggactgaatgatgcaatcgacttatcttctaaattaaatctttctacaccggtagctaatatcggaagcttagttgtatttgctctgattatattaagtttattgaaattttccgtctggaaaaaaagaaagtaaatgatgaaaaaaaataacaatgtgatttcagagaattatctggaacgaaaaccaagccgaccggagggcatctcctggtcggctgatgaaaatggaattattacactcgacattgaaaataccggtgcttttaaccgaattgcgcaaaaattttttaaaaaaccaaaagtcacacatatccatctggatgaaatgggaagctttgtatggcctttattagatggagaaaaaaatattatcgaacttggaaaagaagtcgaaaaacatttcggtgaaaaagcaaatccattatatgaacgccttgccaagtattttcaaatattagatagttatcactttgttgagtggaagtaaaaaatagctcttatcatgaaattgaattttcacgataggagctatttttatttacttttattatttactttttctttttgacacaattatcatctgagcttataatatctgtagatttttttaatccaactttaacgaaaggacaccttttatttatgtttcaatgccaatccggatacacccttcgcaaaataaaagacacctgctatttactgccttatggtcagcaaatcgcagatcaacgaaaaggcatggttttgaatgaaaccggaaccttactctggaatcttctgcaacacaatgaaggcatggaatttgacgaccttgtaagtgcgattgccagaatttatcatttagactccgattcaattccaatgctttgtgacgatgtgcgtgactttcttacacaacttcaagcaaacggaatccttgtagaggatctccagccagtttccaatttcactacaatttacttagaaattgccggactcaaactgcagatttatgacccaaagcagcttctcttagagcaatcggcactcacgcattttgactcttttggttttgaaccggattcttccccaaatgccaaagctgaccagcgctttgaactgcttacaattcctccggcaagccacgcttatggagaagtactgcttcaaaactcagaactgagcgtatttgaacacgccaatcattacatcatcgtctttcatcctatgcaaaatttatatgaagcgcatatgaccaaggacggaagttatgtccgaatttattgcaaaccggaacactccgatactgccactgaaaatttatttcatgctatccgtttattttttctttttattgctcaaaaaaacggattatttgcgattcattctgcctctcttttgtatcatcaaaaagcatggctgttctctggtcattccggagttggaaaatctacacatactgctttttggaacacactttttcaaactccatatttaaatggcgacttaaatcttttaggttttgatatcaaaaaaaagcagattatggtttatggaattccctggtgtggaacttccgggattttcactgcacaaaattatgaacttggtggaattgttcttctcgggcagcatccatctaaaaatcattttgaagatttaaatgaatcagaacagattcttcgggtgatgcagagaatgatttctccggtctggaaagaacaacagctttctttgaatttgatgtttgctgaagaaattgtttcccatgtgcctgtattttcttttctatgtatgccagagccttcttctgcacaaagcttaaaagcaggaattaacctttgggaggataaccatttgacatgaaagaaaaaatttctcttatatggaaacacttcaagcagggttctttacaaaaaatatggcttcagaccttatggatttatcaatacggaaaacattattggaaatctatgcttatctatactttacttgggcttaccggaaccgtggtttccctcatctccagtctgatctccaaggatttggtagatattattaccggtcatcaaaccggaaaattagtaagcacctttattgcaatgattagcttttctatcatcagcattctgatttctcaggcttccagctacgcatctaccttcattaatctaaaagtagatactgagattaaaaatgacattttctccaaaatgctcgttacagactgggaagctttgaccaaatatcataccggagatctggtaactcgctggagtgccgatgcttcaaatatttcaagtggagttttaaactggattccaaatctgatcatctacgtctttcgttttctcagtgcactggctattgtgctttactatgatccgacttttgcactgtttgctttgattggaattccatttagtgccctgctttcgcgaccgttattaaaacgaatgaaacaaaacaaccagcgcagtgccgcaatgaatgccaaactctatggctttaaccaggaaagtttttcaaacattcaaacaattaaggcctttgacttgattcatttttataccaataaattaaaatcactgcaacaggattatatttccatgcgcctggattttcagaaaatgtccatgctgacttctatcttaatgtctatcatcggatttattgtatcttatagttgctatggttggggaatttatcgtgtgtggagtcaggcaatcagttatggaacaatgaccatgtttttatcgctctccagcaccttaacggcttctgtaaattcattggttggcttaattccctctgcaatctctttgactatctctgccggtcgtcttatggatatcgtagagatgccacaagaagaccatagccaagacactctggtaactgagtttgaagcgcagcacaaattggaaggcatcggacttgaactaaaagaattaaactacgcttatcataccggtacagaagttttcttgaatgccaatttaaacgcttacccacatgaaatcatagcgttagtcggtccttccggagaaggaaagacgaccatgctccgattgctgctctctctgcttaagccacaaaacggagacctttcggtatgttccggagcaaattttagtaaaaaaatttcattgtctccttccactcggaaattattttcctatgtgccacaaggaaatactatgttttccggtaccattgctgaaaatatgcggattgtaaaaccggaagctaccgatgcagaaatcatagaagcgctaaaacttgcctgtgcctgggaatttgttgcgaaattgccggatggaatccaaagtgagataaaagaacgaggcggtggactttcagaaggccaggcacagcgtctttcgatcgcacgcgcattacttcgaaaatctccgattttgcttttagatgaggcaacttctgcacttgacgttgccaccgagcgaaatgtattaaaaaatatcatgcaggatacttatcccagaacctgtattgtcacgacacatagaccaacggtattaaatatctgtaccagggtttatgcaattcgggagaaaaaatgtgagtgcttagccgaatcagaaattcaaaaactgatagccgaattttaaaaaaacctctgccgctgtgaacaacatagcgacagaggtttttttattaatttattagtttacagaataagtaaagctttccatcttaagatcatcaatgctggttccatgatcaatatgaattccaattgtaagtggatttgatgcagtacttgcaaaagttaaagtagcggtacttccattccatgcgcactgtactgatgcatcgtctgtctcaacctgatctacggtatcattaaacttaatgtttaaagtgatggttccatcaattccggaccagtctgccatagccaaactttttccgccatttgtaccccatctgtcccatactccataataagttacatttaatgtgccctgtgttgctccacttgctgcataaatcccttctgccattccactgtccactgtaattaccggcttttcgtatgctctcatttgtatctcctcctttaaaactatacttactaagttaagatttgtttttttattatcatattcatatattatccaaaagtcaagaattttttaataagatttattgtactttgtgactgtcaatgctataattacaaaaataattgtaccttatttagacaggagaaattatggaacctaaaattgatctcgaaaaattactaaatgacggtgctatcatccgcatcaagcctcagggctatagcatgtatcctttatttattcccggtcgtgatgaagcgctgattcaacaagtcccgattggatatttgcagcgaaatgatgtcgtgctctatcgcagagcacatagcattcttgttctgcaccgaatttatgctgtcactcctgctggtttttttatggttggagacaatcaatctgagcttgaaggtccaattcagccggaacagatcaagggaaagctgattgcttttattcataatggaaaagaaatctctgttgacaatattctttatcaaatcctttcttttttatggctctggctgcttccaatccgcccgttttgcttcaaattaagcgcttttttgcgaaagctaaagcagaatctctttcgcttttaacagctgcacgactgcttctacatcttcgtagacttcatccggcgttactttatactcttttgccactaacagagccagttgctctatggtctctgcttcttcggcatgctcatagataaaaccagcggtttcactaagtgaaaggacttcatgcactgcttctgtcttttctccgacaggcagaagaatccattcatcttccagttgcttcatcagatatccatttgattttttcatatcaggtttccttttcttagatttatgctataacatttttatttcaggagtttatttttatgaaacaagtataccatacctatttaagtattatcaaaaaaaattgcaccgactccgagtgcaagattgtagttccaaaagaagaatattctcaattaatagaattggcaaagaaacagtgtacgcttccgtttctcttgccttactttcgtgatacgccttattttctgttcttgaaacaacagacgaaacagattttactaaactattatgagctggaacattttaccagaaaaacggtttcattactttcacaaaatcagatttcctgctatctcttaaaaggtctaagccttgccgcttattatccggttccggagtatcgcaaatcaggggatgtggatttatatatcaatgattccgaaacctttgagaaagcgaaatctctgctgatttctcacggatatgtcttacaagatgaactcagtgaccaccatatgctttttttatacacgtttccaaagaccgggcgccaatttgaactggaactgcattatcgcattgtcgggttatatcaatatgaacaagccaaccaaatcgtggaggaagtattttccaatccacctaagctgacacaaacactctatggatactcctatacggtgcttgccccgactgaatctgcattttatctgattcatcacatgttaaagcactatctgtacagtggtttcggaatccggctgctctgtgattttaccgtttatttaaaccatttttataatgaaattgattttgagaaactgcatgcctggtgccgagaatccagaatttttcatctttatgaaatcattttagcgtgttgtcaaaattatctcggacttgcagagcaaattgatccggaagttacttatgatactgacgcctgcgaacactttctttcgatgattttagaaggaggagatatgggtacgaatgcgaatcatgcgattgtcggatccacctcttatcaaaaaataaattggttgacgtattttaaagaaggccatctgcaaatgaaagtacgctttccaaatgcctcccatctccctgttttatggccatttttatggttctggacctttgtctgctttcttaaaaataatcgaaaacttcgaaacacaacatttcgggcagtccttcgagagtttaaagaaaaaaatgaacacaccaggcttatccgtatctttgaaaacagcgactcttaataatgagccgctgttttattcttttattttatcctccacaactttgtagccttcaccgattttatttacaatcggatcatatccaagtactgcttttagtttctttcgaagtgatgacatatgaactcgaattgaaccactaaaactatccgcagacgcatcccagacatgttcaattaattcctcctgactaaccggtctgccttgattcaaaagcaggtattctaagattccattttcttttcgggtcagcgccacaaattcgccattggcataggcttcccgcttttttgtatcgaactttatgcctccgcaagtcaggcacacatctttttgcacaaacttacggcgggtcaggcttcggatacgagcctctaattcttgtaaatgaaatggcttttccatatagtcatttgcaccggcatccagcccttcaactttatctgctatctgacttcttgccgataaaatcagaacctttgtttcctcattttttttgcgtaattcttttaaaagctccattccatccatccccggcaaattcaggtcgagcacaatcaaatcatagttttctgccaatatataatccagtgcttcgctgccgtcataacaggtatcgacttcatagccgacgtgatacaaagttttggcaaccgtatcacataactctttttcatcttcaacaattaataatctcacggtattttccccatttccttaacagaaattttacaccctctattgtataatacttatgtcgacaggtcaacaaagacaaatttggtcaaaagaaaggagcaatcaatttttgaagagcaaacaaatactacaacttatcttacttgctgccggtattattctggtgacgtatgggatatccagaggagaagcggctgttgtacttagcaaagcaattaaattatgtctggagtgtgtaggaattggataagaaaacaaaactcaaatcaaagaaaatcgcaggcttgcgtggttggattcaggcggtcgccaccttgcttacaaatatacatattcctaatttatttaagggaaaaatctatcagggggctgccaaaaatgtctgtgtaccgggactaaattgctattcgtgtccggcagctaccggagcctgtccaatcggagctgtgcaggcagtgattggttcctcaaaatttaaatttacttattacatcaccggattttttattttgctgggtgtactgcttggaagatttatctgtggattcttgtgcccgtttggatggtttcaggatttacttcataaaatcccgtgcaaaaagttttctaccgcaaagcttaagccattaagatatctgaaatatttcatcttaatcgtgtttgtcatcctgcttccgatgcttgtgacaaattcaattggaatgggcgatccgttcttttgtaaatatctttgtccgcaaggcgtgttggaaggtgccattccattagcaatcggaaacacagcaattcgctcggcacttggcagcttgtttcgatttaagagtattatcttaattacggtggttgtcttaagcattttattttaccggccattttgtaaatggatttgcccactgggtgcaatttattctttatttaataaagtatccttgcttagcataaaagtaaaagaggatcaatgtattggttgccataagtgtactactgcatgtaaaatggatgtggatgtgctaaaaaatccaaatcatccagagtgtatccggtgtggcgcctgcatgaaagcatgtccaaaagatgccatttgctttcaatttatgaaaaaccaaaaataaaacatatatctataaaggagagtttaaccatgaaaacaagaaaaaatattattaccattctcacactttgcgcagccttatcactgactgcatgcagcggaaaagacactactgaaaagaatcctaagaagaacgaaagtactacctccgatacaaaagagtcaacggatgcttccactaaaaaattagatgatctctatcagcaggaaaatcagatttttgcggatcatagcgaagtatgggataaagtatttggcatgatgagcaagacaaatacagattccgatagtgcctatgcagatttccttaccgcaaccattgaagaaaataaatcttcttttacagaggatgaactcaagacattagagagcgacattgaaaccattcgaggaattgaagaacagatttccaagctggaagatgaactggcaacaaccggctctgcggatacagaagatgctgctgatgaggatactccatttaaagatctttccggaacagacttcgacggaaataaagtggatggaactctgttttccaacaatgccgtaaccgttttaaatttctggtttacaggctgtaaaccttgtgttgcagaattatccaaactcaatgaaatgaatgaagcaatcaaatctatgggcggagaagtcgtaggaatcaacactgaaactttcgattcaaatgaatctgcaattgaagatgccaaaaaagtgctggaaagccagggcgcaacttaccgtaacctttctattgcatctgattccaatgcaggaaaatatgcttccgaaattatggcatttcctaccacgattcttgtagatcgaaacggaaagattgtaggcgatccaatgcttggcggaatcgatgatccggataattatgatacgcttatgagccagattcaatccgtgattgatgcagacagtgcaaataagtaagtaaaaaatcatgaaaaaattatcaatccaatggcgacttacaatcatcactacattattcattgcattaatctgcggatgccttacgttatttatctataaaagcggagtttactacattgattctctgcaagatacggtaaatgcccaaaatgaagacgacagcaaagacggctcggaggaaatctatatcagcatcccagatgaaaaatggcaagattttgcaaatgatttttccattcaagtttacaataacaaagcagattataggaaaacaagtctgattctttccgcactgatggcgcttttgggcggtattattaccttttttataagcggacatgcgctaaagcccctcagtgaattttcggataaaatcgaaaaagtacaggcacaaaacctggcagcttcacgaattgaggaaaacaaagtcaaagaactcaatcaactgagtatttcctataataagatgcttgaacgactctctgagtcctttgaaacccaacgccaatttaccgcaaatgccgcgcatgagcttcgtactcccctggctgtcatgcaggtacaacttgatttgtataacgctaccgaacatccggataatgatgagtgttctcaaaaaacgctcaaaatggtgaccgaacaaaatgaacgactcagcaaaatggtaaaaacccttctggatatgagtgaactgcagaccgtggcacgcaacgaagaaattgcactcgatgcactcgtcgaagaagtcctcgcagatttagagccgcttgcccagaagaaaggcatcacccttaccggaaactgtgaagcccttactatgacaggcagcgacatcttaatctaccgacttgtttataatcttgtagaaaatgcgataaaatacaatcgctcggatggtcaagttaccgtaaccgtagcaaaaaaagaccaaaacatcattttatcggttgcggataccggaaatgggattcctgaagcactcaaagacaaaatctttgaaccgttctttcgcattgataaatcccgaagccgtgcacttggcggtgtcggacttggtcttgcacttgtgtatgaaattgtaagagtccataatagcaatattactgtcaaagacaatcctgcgggtggtacaatttttgaaattgttttttaaacatgcaaatttttttgcatctcttctttaaactctctgcctttaaacaacagcacgcctactaaaaataaaaagcacgccaatgcaccaaacatactcacagttgggcgcttcaccactttgcaaaaaagcaggatgcccggaataatcagcccgtatccggcagccataatttcatagatcagatactctcttaccgggcttttctgcactcttgcaatcacacacattgcaagcagaattcctacactcatcagcggcagcacaaaatcgaccgaccagctatgccatccggttaatgcatcccagataaagctaatgatggttccgattaacagctgccacatcaaattttttaataaattgtagcgtttaaagaagccaattgacgaggcaatccacattgttgcaacgcctccggcggtaaacagtgtccaacgaatcttcggatggaaatttaagtcggtcaccaacatcaatgccactagtgcaatacataaaaaactataaattttatagactttcatctcctgctcacttggcatcgttggcttcggaaagaccggctctactttttgggctgaaattccctgctcttttaataagcgataaaaattgcgttcaatattttcggtatcatatctggaggtaaatgcaaaggacaatttatcttgaaatgaacacagacataattccattttcggagtgtttgtatacacaccaaatcgctcaatataaggcacatagcttttgggcattttaaccgcactcatattagaaaaaattgcggttacatttttttctgaaaattttgctcctgcctgaatacagagattcttaagttccagcggtgcgagccgcaaaatcgggtgtagttctaatgcaagtaattcactgatatgtgccgacattttttctttggtcaactcagcttcaaaaaaggctttcgtgtgattcaatactgcttcaaagcttccatcttgcgttgcaaaatcatatcccggttcaatccagttaaagaaatttaacatcgacgtcgatggaaaaaattttcttaaatttaccggtaccattaatatcacagaacgttttttctgcatcttcgacatttcttcgtgaatagccatcatatagattgccgtcaaaaagatggtcatagaaacaccaagctccctgcttctttttaagattgcctgtaccgaaacaatagattcatggacatgcagacggtttccatctttcttttttctacgtatctgaaatgcatgcagcttcctttttttcggtcgtttttggtcttttgaataatatttcaggaaactatcatcttcctgatcctgcactgtcatatcttccggctgcagggaaacctgctccagtccctcttctttatgcgcaagatacagatagtttttcaccaattcttttaaaaattcagttgctccggtgccatcggtcagtacatgaaacacttcaaaattaatgcgtttttgataatacgtcacttcaaacagcagggtctttttgtctctgatataaagcctgctgcaaggctctttatactcttcttttacaaccggacgtaaattacaaggctcaagataatgccaaaacagaccttttcgaagtaccataagaaaagtcggaaaagtttctaatgtctgatccagcgcttcttgcaaaagctcagactgcacttgctcttttaattcacaataaaatcgaaagactcttgtatcttttttattactggccgcagaatataattttgctgcattatccagttttctccaatgtgcttttttttgcttcacgatgcttcccctttcaaaaattcattgatgtaggtgaaactttcctgcacatgcagctgcttgattcccaatgcgaaatagccgtgaagggcatctttaatccgatgaatctgtacccggttgcccgcttcttttaagcgttttccatacgcttctccctcatcccgaagtggatcaaattctgaggtaagaatcaatgtatccggctgattacttaaatcttttgccagatatggtgcaaaatatgggttctttttatcttcctcatttctcgcatagaggtcaatataatcctgcatttttcctgctgtcaaaagataatccgttccattttcttttacagaggcaaatggcgatttttcggtataatcgttatacgtagcaggataaattaaaatttgtctgctcggcataaactcttttcggtctcttgccatcaaagataatgcagcgcaaaggtttccgcctgcgctgtctccaatcagtgtaatgttttccggctttacatttaatacaaactgaccggaatataacgcctttgcaactgcataacaatcctccagccctgccggaaatttatcttccggtgccaatctgtattctacagaaacaacatactgtccggttgcatctgcaagtcgtgcacagattctttcatagttgtcaatactctctgtcacccagccaccgccatgtataaataaaagcagctttcgctcttgactgtccgcttttttttcttcactttcccgaaaacttttttcatttggaaagaaaatacgaaccggtactgcatggctcccgttatatattttttcatctacttttttataaaaaattttcattggatccaatcgctttaaatccgccatatgacgaaacatttctacttctacaccatcaaaagaaagtgcttttaaaattttctttgccgcttgattgatcaatattttttactcctttttatgcataaattttatattgattaagttttagtatagcacaaagcgccatgaatgctctagggtttttcctctttctaacttttaattatttggatgcactcaaaacactacttccgtatctctggcatacgcatttgaaacaatctccattggcactctctccagccaatcttcgccccactcttcacgcttttccaacacaatcatccgtcctgtttccgtaagcactctggctaagcgatcttccgatgctgttagtgacggtttatttcctgaataataacccgccgttgaactaggtgtctttccatacttttctgcaaaacaagagacttcctttgcagttaccattcctccggctctgtaaatttcttcaagtactgccactcttcttatctctgcaagtgtcgcagttactgtgttatgttcagcttcaagccgcgcaattattgcagatagctttgcctgcatttcttttaattcgtcgagtaaactttgcatgattttcgtttcctttcgtatttcatccttcaaaccgttctttcatactttatatgaataccctatcacagctcgactgctttgtcaattcattgttttattcattctttggttatcataatgaatttttgcaaaaaaacagtttgcgttaacagaaaacactcctgttaaaacaaactgtttttaaaagtgctgcaacgaccaatagagcgaatcacttcattctactcttcatcattttgttttttacaggttccttccatctttgcaatttcttctgtggtatattcctctacttttgtctttgttactgattttatatgttgctttttcaatctcgaatatacaaattcgcggaaaatcgtatacaatacagataccaaaggaataaacacaagcattcctacaattcccataagatttccaccaattgtaactgctgcaagtacccagattgatggaagtcctacagacccacccacaacatgtggataaatcagattgccttcaatttgctgtaaaacaagaaatacaacaataaacaaaattgcctgtttgggactcaccataaaaatcaaaaaacatcccattacgcacccgataaatgccccaaaaacagggattaatgcagtaaatgcaattaagactccaattaaaagtgcatatggcattttcaaaatacttaatgtaatgacaaacatacttccgagaatcacagcttccacacactgtccagtaaggaaattggcaaatgtgcgataagtcagggaacaaatatcaagaaacatcgtcgctttttgtttcggaataaaagcgaaaaaaatctttcttatctgtacatgtaatttctctttttgaaaaagaatataacaggcaaaagaaaaggcaataaagaaagttgcaaatccactaacaagggagcctactgctgacattgtcgtattcatcatattgcctgctccgtttccaagaacgctgattccccacttaattgctttatcagaatcaaattgcacctgatttaccaggctcataatttcctgattatcattggaaaactttcgaatccactcttgcatctgcggaataaaatcagcaatacttgccattaagtttcccattgttcgcgtaagttgcggaattacaccaaacaacactaacagaatcacactaagcactaatataatggtaagcagcagactgactggtcttgcaaactttccccctgcctgttttcctgcttctgctttcccaaaaattttctgttctaaaaaactcattggtacattgatcacaaatgcaatcgctccaccaagagcaaaggggaatacaattccccatagctcttttattacgtggattactacatcgaacttccataatgcaacaacaagaagtacagtaaatgcaatcaattcccgaatttttttaatattcattttatttaaatccattattattctccattttttcttaattttatgcgtacccatttaagaaattgaataatcggaaggctgacaaacgcatacagatataccaaaccaagttgaatccaattcaaagtttctactttaaatattatatgaagttccggaatcatcaatactgcagtaataagtgctgcaccaagtaaaaatgctccctgaagccatttattattaaaacagcgttttgtaaagagaaccggatgatctgatttacagttaaatccatggaacaaacgtgccaggcagagtgttccaaacgcatatgtacttccgagtaacgcaccgttttgatgatagcctgtcaaaaatccaatcatcgtcattgcaccaattaccaaaccttccagaccgactttaccaagaaaatcttttgtcagtattgactcatctgcggatcttggtttttcattcatcacttcttggttatgtggttccattcctaatgcgattgccggaagactatccgtcaaaagattaataaacaatagatgcaccggtgcaaatggaaccggaagccctgccagtgatgcacaaagcaccgttaaaattgctccgaagttacctgataaaagaaattgaatcgcagacttgatgtttcgatataaatttcgtccattctccactgcttttacaattgttgcaaagttatcatctgtaagcaccattgccgctgcatctttggcaacttctgttccggttactcccatcgcaacaccaatatttgcctgtttcaatgccggagcatcatttacaccatctcctgtcatcgccacaatcattcctttttcctgccatgcacgaacaatgcgaattttatgttccggtgatactcttgcatatacagaaatattcggaacaaactctcttaactgctcatcactcatattttcaatctctgcaccttcacaagcttccgataaatcatgcaatattccaattctttttgcgattgctgccgccgttattttatgatctcctgtaatcataaccggacggattcctgcttttatgcactcttcaactgccgcttttgattcctctctcggcggatccatcatagcaattaatccaagaaatactaaatgattttcatcttctatcgttagtttatgctggtcaggaatttcacgataggtaaatgccaacactcgtaatccttccatcgaaaactcctggttttgttgccggattttttctttttcttcttccgtaagttctcgaaccccagcttttgtccaaattcgttctgttcgttctaaaagccgatcaacggctccttttacaatcattcgattttcaccgtcaatttgatgcaaggttgacatcattttacgctcactatcaaatggaagttctccttttcttggataaagtgttcttacacttgcagcttcaaccccatatcgacttcctaaattaattaacgcagtttctgtaggatctccgatttccaccccattttcatttgttgaatcattacataaaatactatcgtccaaaagtcgtctttgagccaggtctgttatatcaattttacttgctgaaatccgttttccatctatataataatcttccacagtcattttattctgagttagtgttccggttttgtccgaacagataatagaaacacttccaagaccttccactgcctgaagtttacgaataattgcatgctcttttgccattttttgtgttccaaaagaaagcacaattgtcacaatcgaactcaacgcttccggaatcgccgcaactgcaagcgccactgcaaacataaacgcactgctgatttcttcaccacgaaatacgctgactgcaaatagaattccacaaaatattaaaattaaaatagaaagtttttttccaaatttttctaaactcatctgaagaggagtttgtttttccgaagtggatttcaaaagccccgcaatctttccgacttcagtctgcattcctatctcagtaacaactgcttttcctcgcccatatgttacaaagctaccggaaaataacatatttgttcgatcgccaagtgatgctttctccaaaatagtatccatacttttttcaactgcaaggctttctccggtaagcgcactttcatcaaccttaaggcttgcattctcaattaatcttccatctgcaggaaccatatctcctgcctcaagtaaaattacatctcctacaactaactctcttgccggaagttgaatggctgtcccatcacgcaatacttttgcctctggtccggaaagcttcttcaagctctgtaacgattgttccgcctttactgtctgtattgttcctaaaattgcattaaccgtaatcactgtcacaattactgcggcgctctctacatctccaagcatacctgatatgactgctgatgcaattaaaataagtaccaaaaaatctttatactgttcaaagaaaatttgaacaatattttttttcttgccttctgcaagctcattccaaccacatttttctctagactttcttgcctgctcacttgtaagtcctaattctttactacctacctgtttaaggacttcttctactgtttgttgataaatttctttcattacgtttcagcctcctctgtttactaatgtactctgcttattatgcaatgaaagactctttcgataaaaatgtataaaaaaagaaaccattattgcataacaaaaaatgcaataaaagtctcaccatttttttgtggcaccggatgtctccatcgtactgacgataccacaaacgctatttacaacgtaggttactcccctttattagtactaatcatatactaaaaatgctcccctgtcaatataaaagattaacagacaccctaattcatgctaaaataaaactaacaaatacacaaaagtaggaggtatccattatgaaagaatcatttgtgcacgtatacaccgggaatggcaaaggaaaaagtacagcggcgtttggtttggctttaagagccttgtttgccggaaagaaagtgtatattgcccagtttatcaaagacatgaaataccacgaaaccggcatagaaactgtaatggacggcatcaaaatcgaacagcttggggctggctgtttcattgaccgaaaacctaatgaacatgatagagaagtcgcaactgcagctttacaaaaatgcggaaaaattttggaatccggcaagtttgatgtggtgattttagatgagattacaatcgccctatatttcaaattattttccagtgaagacgtaattaaaattttgcaaagtcgaaacccaaaagtagaagtcgtcctcactggaagatatgcaccgcaggagcttattgattacgcagatttggttacggaaatgcgtgaagtcaagcactattatactcagggtgttctatccagagatggtattgatgtgtaacaaatcgcaaaatcatcaatcctattcataaactatttcagttcgcaggtaaaatgctggcgcagctgtgccggattttcacactccttgccaaaatcaataaaactgcgtccgctgtgaactgcaatatacagcctgcctccaaagttgagatttataatgctctaaacacctgagcaaaaacagtgggaagcaattacagccagctttccagaacatcattcagcttattcatatccagcggttttgcgatatgtccattcatgcctgtatttttgtcaagctgtacgtcttctgcaaaagcattggcagtcatggcaacaataggcagttttcccttttcacccggaagactcctgattgccgctgttgcctcataaccattcataacaggcatttggatatccataaaaataagatcatacgaacctttcggagaagcttccattttctcaactgcaattttcccattttctgccgtttccacttttgcacctgtcatctgcaaaatttcaccagcaatttctctgttcaactcattatcctcaaccagcagaatccttttttccgtgtagtctgattttgacagcttctccaaataatttcttgctgttttttcttttcttcctgaagtaaactgccgcagtgtagccgtcagccgagaacggaacagcggttttgcaataaaagcatctatgcccgccgtctttgcttcttcttcaatctcgctgaattcataagatgtcaatacaatgatggtgatctcttttcctatccgtttccggatctgtctggcagtctctataccatccatatccggcatcttccagtctaaaataacagcaaagtaatcatctttcaactcatgccgtgcataacagtgctcaaccgcttccctgccagagagaacccattcacccataataccgatttccttcagtgtggcaactgtactttcacagcatgtcttatcatcatccactaccagaaccggcagattcatcagatttttgtcctgttctttttctttttcctgaagctccagataaattgttactgtgattttagttcccttgtgcaagatactatccactttaatagtgccattcatcaggttcacaatatttctgctgattgccattcccagaccggttccctggactctggttgtccggtggtcatccgcgcgactgaacggatcaaacatgattttctggaattccggtgacataccgatcccattatcctcaatcgtaaattcataacatccaagttctgaaaatccatttgacttttcctctatggaaaaaataatattcccgccatccggtgtatacttgatcgcattactcatcagattcacaaatacctgctgaatcctcaagctgtcaccacagacagcctcatgttcaatatgattgatgtgtatatcaaaattatgttgatgttcatcaagcagcggtttcgtaagtgtaataagattatctaccagctctgacaaattgaaatcttcctgtgccagtgtcatttttccactttcaatacgtgccatatccaatacttcattgatcagccccagcagatggcggcttgattctgtgatcttgccgaggcattcaatgactctgtcctggctctcaacatttgctcctgcgattgccgtcagacccacaatcgcattcattggtgtccggatatcatgggacatattgttaaggaattctgttttcgcacgatttgcattttctgcggaccggtaagcctctttcagcgcctgacgagattcaatctctgctttcttctcctgcgtcacatccatggatgccagcaatacttttaccagttttccattctcccattctaacggaatataagaagcgattttataagtcttttcatcccggctgcagtactcaaacttataaatatcattttcacctttcagattcttccggatattatccgaagttatcaggatatccatagcctgcagtggttccagcgtcttatacttttcaagaacctgcatctgaaaatcatgataaaagcccagaggtttatataccatctgcccattcaggttgtaaaattcatatctgtcattttccagatcacagacaacaaagcggtcaaccagacgcacaatactctgaatcagctgctccatggaagcattatccgctgccatctgcagatgccgtgcgctctctacctttgcctctgtgatatcacgcagaaagatcatggcatattctgaatcctctatttcgccacgtatgaccacattgcggacccatcgttcttttccattcagagtgatacggcactctaaagccaattcggtttccagacccttcagcctttctgcaatataaccacggtcgtaaaaagaggataccgccttcttatctgtctccacaacataggaatccacaaaatgccgaatcaattcatcccacgtatgactctgttcaaagacggtcatcagggacggttcaaccttaaaggtatcaaaagtattcgcttccagattcacataatactcgcacaaatctgctttcgtaaaagcccggtggaaagcagcagatttttgtgcctgcatgatttcttttttctccccatcaatgttaataaaaatcccggcaatcctgctagcagaaccatccagacggcgtattacttctgccgatgcccgaaaccactggtattgattatccttcattctcatacgatactctacctggtattttatctggttcgtcttatccttaattgccgcctgaagctgcaccatgactctttctttatcctgtggatgcagaagatctgaccaggattccagtttattcggaaagtccagagtgtcatgatagccaagcatttttcggaattcatgactccagtttgcattcacaatctcactgttttcgtcacagtcaaaataccagaagccggaacagatagcctcattgagcagtgccagatttacatgatcccagttgacctgtacggacataacccagatctgtctgcccgcctcatctgtcgcatcctctttacaaagccgtacattattcactgtaccatctgctgcaaggatctgtgcttcccctgttccgtgaagctgcaaaaaacggtcctgatccagtatctctataccatctccataaaagaagtttttcaatgaacctttcgtctgcttcataaaagaatcaaaggtataccctgtactatgtaacagcagattgctcacagacaaaatagacaggttttggtcataatatcctgtcattatacctactccgccattattttccagtgttttctgtactacctgtgacatagcccgtgtttgtcccgatacagtctcacttaaagaatatattttatcttcataatttcccattttataaaaatcctcacttcgttttatacctttttcatcctgcttcaatctgcctattgaaaattttcttgctgtctaatgatttctgataatgtcgacagcaacttatcaacttggattggctttgctatatgaccattcattccagccgcaagagccgctttcttatcttcttcaaatgcatttgccgtcattgcaatgattggtatacacgttttagctttatctggcagatgtctaatttcctgtgttgctttataaccgtccattttgggcatctgaatatccataagcaccatatcgtacgtacccaccggcatttccattatcctgtttatacactgaatgccattctccacacgttctgttttaagaccggcacgctccagtattatttctgcaatctccgcattcaaatcattgtcctctgctaaaaggacattcctgcctttcaggatcccactacctgtttcttggttttcaacatatttttttgcataatagcttttatccgctatcttgtgctttagtgtaactataaagacgcttccctttccaagctcactttctacatttattgttccaccaagcagagcaacatatttttttacgattgacattcccagtccggttcctgtgattttgctctttgtggtgttctgttcccgtgtgaacggctcaaaaatctttgtcagataatcctgactcataccgattccggtatcgctcacccgagttcttactattatgtatcctgactcatcgcatggtaattcctctacgtttaccgtaacaaaaccgccggataaagtatatttcatggcattgctcatgatattaacaaatatttcctctatcttggtaacgtctgtcaatatgtgcttatgctctacatccaccttgtaatgaaatacaatattcttcttctttgcttcatcctcaaatagttcaaacaaattctgccagatagcttcaatctgggcataattctcatcaatctccatccttccgctctcaatccgagccatatcaagtacattgtttatgattgacaaaaggattctgccggactgttgcagtttttccagatgttttgaagtttcggtcagttcttttccttttagttcatcctccataagctgtgcatagcccagaattgcattcataggagtacggatgtcatgcgacatattgttaagaaaatttgtctttgcaagactggcattttctgcttttttcagagcaatttccagcttatcattgagtttttgtgtattatttgccgcaagctttgcgacagtttccgctttttttgcctttcttaaaagtacgagaataatgccaattatactaaaggaagaaaaacctatggtgacaaaaacaacaagcagattgtcttttacaaagtcagaaaatgtcaccttacctgccgtactgtcataaatagcaattgcacttgtaagcatatcagacggcatggcctttaaagttttattcagtatcgacaaaagagctgcctctccacttcttatcgcaaagcatgcctccattgtttttgtaagtggaacacttttgaaactccggctgttatcatatatcatcgcctgacttgctcccatgaggaaacagtctgctttttcaccggaaaccatatttgcagcatcctcaagcgaatcacaatctacaagcttccattgtggataactgaacgcaatatgctgttttaaggcatctttttccttttgcacagctactgtatacacattattttcatcaaactttttctcatctgttaccgccatcagactgtaagtccacgctgtatttgtaagtgcatatcctttttcttctgcaaaatcaggatttctgctggtataaaaaataatatcaatttcatgttcctgtagcgcctgagtcatttcgtcataattatcatacgacttcatattaaactccagtgtctgatcattcaggcaatcttttgcataagagatatattctgacagcatgccggtaagttttccagtctcttcatccatagaaaagattgccggatcattgtttaaaaatcctacccagatatcaccatgttcttccagataggacttttcttcacctgtaagaatctgattataatcaagagtaaaatacttcttatacagatctgcctgaaaaaaaggactatcttgagccaactgacgcatagcccagtccagttccgtcttgacatcgctgcgctctttgttcattacaaaatatatacctgatttaccaatattggtaacagatgatattccctgttcagaccagatggattcctccaaagatataaaacagtctatctcatgatttgctaatttcttttcaacatcatcattattatacacatttatatgttctgtatttatgccgttcttatcttcccactctgtcagcatgatttcaggttctgtacccatgagcacacctacacgtttcccatccagagacttaaaatcagaagtcacaatatccgtatttgacaaatcagcataaagaatatatttttcctctcccatcggttcctcggaaaaaagcatcttttctgtacgttcatcggtgtaagagatatcacccataatatcaatctcacccttttcaagcatgtcaaaacagtttgaccagtcacatttcacatactcaaatttccatccggtatagcttgccagagcctgcatgagttcgtagccaaatcctcgtctgacaccgtttttatcaatataattaaaggtatcctcaaacgaaccgacacggatgatcttctgctcttttgcctgcatgtctgatttttttgtttcctgttgcgttgaattatcctgctttgccatctgtagctgttctttatcattatctgtttcagcagcccagcaatgtactgataacatcatccacattcctaaaaccacaagtatacctatacataatacgactaatctttttctacttttgtacattgctcttttctccacaatttaccaggttattacccagcactgattttctatttatcgttttccctacctttttcatcattatatcttgtattgttaacttcggtcaacaatgcactcttatttttgtcttttttgtggatatcattaaatttaatttaacctcaacagattcattaccaattttaccattacatctttttcttccgcttttgattcagcaatcattaatgtaattgctactaacgttccatcactgagtctcttctctccatcctgaaacagcgcattgttcttgtctaaaaattccaggaacagtgatgcggcaattcttttacagccatctgcgtatggatgatcttttatcataaaatacaataaatttgccgctttctcttccaaagacggatacgcatcttgtccaaatacactttggtaaactgcagcaataattccttctaccttaccggtctctttttccacaccaaatacatctgtttcaaaagaatccttcatctgtccaaccatctgaacacaatcttcataagtaatgcggtatatcggagtacttccctctggcttacttaatgcctggtggtcatattgatccagaagaatcaatgcatccgtgtattcatttatagctctgagcacatttttttcttctatgtcaagtgcatccacaagcatccttgactgaatatcaactgttttcctaagtgcctgaagatgattttcattgagcgcatagcctttcaaaataaactgtttaagaacactattgacccattttctgaaagcgatacctcttttggaatgaactcgataccctacagacaaaatcatatccaaattataaatcttaggttttcttccccccgtacttctgtcggaaaagccgacagaagtctcatccaattctcctgaagcaagaatatttgagatatgtttgcttactgtagcgcgcttaacctcaaacaacgcttccatttgtttttgagtcagccagacagtctcttgctcaggattaatttgaacttctatattaacatcaccatctgtaaataatacaatttcactcttcatcttttcgttcctttccatgaatatttcacgctgacttttccaaaccccattttcagtcagactactttttatcctttgatttataaatgagtagtgaaaacccataggcaaacctatgggttttcactactcatttatcttttttcattctttcactccgcccgtttttaagtattcatccgcatttttacatattttattaaatacttctgtacatatgcgcctttcttcttgggttagtccctgcaagaccgtttttacaaactcattctgcactttaattccatcttctatgatcggaatagctgcctccaataaaacaatctcgatatgcttcttattgtcagtgctttggactcgctttaccaggtctctgctttcaagatttttcaaggaagaggacacatgagattttgtggatttgcggattttgacaatctccgctgccgtattatgccgtggattgttatgcaaaaatatcagtatgtcatattccatctgtgttaactggtatttctcacatacttttcttgaaagcatttcataacaacttgagattgtcttatgttgatcccaaaaaaacatagcgtttctccttcctttcacttcgttctatttagaacgattatatggtgtctatatccccttgtcaacccttacttataattttttccacgattttctgagtgccacataggaaatcagaaaatttgcaaaccagccagctggtacagcaagccagacaaatgagatgccaaaacgaggtgcacagagcaaagcaactgacagacggattgccaggtttaccatattcgcaatgagaaaaggctgcatgattccaagtccgcgaagaactccatccgttgccatcttgatacccataaaaataaaaaagcagccgagccatctcatataatccccggacacctgatatgccaaagcggttccatccttacccagaaataacgaggaaatttgagtatgcagtgtttcaatgattataaaagcaagaactgcaaaacacagatccaataccagtgcagcatgatacccttttttgatacgcttgggtttctttgcgccaagattctgggatacatacggtgagactgcatttccaatagatacaaagatcaatgaaaaaacattttccacccgcatcgttgctgaataaccagcgagtgcctgtgtaccaaatggatttacaactgcctgtacgatcatcataccaattgatactgtggactgttggagaattgatggcacggcgatttgaagcatagaatacaactcctgcccattaaaccaggcaaaatgacttttatatcggcgcatccgactaaagaaaatcaaaagcgaaaacactgcggaaatcccctgtgcaatgagagttgcaagggctgcgccgaacacacccagaccaagtccggccaccatccaaagatccataaatatattcaaaacagaagagaatatcaaaagacccaatggaatttttgactctccgatagatgtgaacatcgttgaaaggatattgtacataaacagaaacggaaagcctacaaaataaacgcgaagatacagcactgcttcatccagtatatcagctggtgtctgtaataagttcatcattgaacgggaaaagcaaaaaccaaaaacccccagaagcatacttagaatcagaaagctaatcaatgatgttgacacgattgttttcattttactataatctctggctccaaaataacggctcacaagcacacctgcgcccacaccggcacccaaggctatacaaatgaagacattcgtaagtgcagcgcaagcaccaactgccgcaagtgcagaagagccgacaaactgaccaacgataatagaatcagccatattatatacttgttgaaaaaagctgcctaaaatcataggcattgcaaaaacagtcaatgctttcagaggcgcatctgtgatcaaatattcatcctttgacattatcttattttctcctccatcagaattttttgtattttcgaaatgtaagttataagtttcgttatgtaataattatatgtagttacagtaactaagtcaagctatcatttactttttgtaatataaatggtatgatatttgatatgcaatggatattattttacaggagggacaattatgtacctagacggtttagatgaactggatcagaagattatccagttgcttatagaaaatgcacgtatctcttactctgatattggtgaaaaaaccggtatttccagagtagcagtaaaagcccgaattcaaagcttggagaaaaaaggtataatcgaagaatatacaacaataataaaccctcaaaaaattagtggtgctgtatcatgctattttgaaattgaaataaagccggaccatctatcgcaggtaacagatatattgtataaaaatgatacagttacacagatttaccgtgttacaggaagagacaaacttcatatacatgcagttgcttcgtcaagtgatgaaatggaatacttcctgtacaatgtcattgacacactgcctggcattatcaactgcagctgcaataccatcttatcacgcattaaagatattaaaggattacggctatgaattatatccaatttagacattgtatagcttaatcccgacattctcatgggatagtaaatttaaagaagtttctgtgggagtactaaacgaatttacaaggctcctcacacctccaaaggaagtggaaagagcctatgacaaacaaaaggattttatttatgaaataaacagccgttcctgatatcctgctctttttgaaatcccgccactccactatgcatatctccatcttttttcactgcctccacccgatacaacattacagaattcaaaacatcatccagcaaaattccggctgcaagaaaacttctctgtcttttataggccggaaaagtctctatttgccctattattaaatttcgtaattccaaatttctctgaatgatctgataaagaagtcttcctcacacagtgccttggtcaaatgcatgtggatttccagtcaccattgcagcaaaaactgccaggtatattttttgtgttttcctgtatggcagtttattaaatatttctgcggaaagctttaactgttgctccagttcttcaaaatcttccctggaatttcctttcagcatttgcatgaaatattccaactccacctgtgccggtgtcccctcatactcgctactcatgcgcagtagcaattcctgctgtttctgcgcctttaagattctttcttcctgtttgctacacagtgcttttccaaaatagctttccagaatctcttccggtgcaagtcctttatagcgactattttctaatactttttgaaatttttcagcagagattgtcacacttttttgccgatgaaaactttttccaaagaatccttccaattcttccagttcttccggcgataagctctgaacacgaacgctccctgaaaatcttccataagaagcatatttttcaaaaaaaccgttcagtaccttttcccatactgaattttgccgaaaatattctacacatttcttcagttgctcatatagaactatatttcaagattttctttgcatattcataaaaaagcgttataatcgaagcagttaaatcaaaggaggtatcaaatcatgaaatcacataaatactggtctctcggagcacttttctgtatgttgggatgcatttattctggaatcaaaaaatctatgactgcacataaatactttgcctattcttcattgctttgtatgggcatgtccatttattccggtcacaaactggtttctccaaagaagaaaaaaatcactgaatcaaacaatagtgaaaataattgaacaaaaaattgacctctattcatcaaagacaaaattgctggagattatttccctccagcaactttctttatctttaagccattaaaacacaatactgtccaatcagcttcgtccaactattatatttattcttttcacacacctttcggcaaatttcattttccatcaatacacaaaacatcttatcataatccaatgcccaaacagcaccattcacatggttctctactgctttctgatctatgcttttcaagcgtgtgaccattttttcaatttctccattttctaagttaccgatatttttgcagataaaccaaaagaaattcaacgttgcatattcgtcatgccaatggaactcttctggattgttttttattttactggctcgctgctgttctttgattatctgatcagctacacctttcatcgaatcttcgtatctcatattactcacctactcttcctcaacgcccagtgacggtttaaatcttttatcctttgcctgcggtaccacgatctcataaaaataaaatcctaaatacccaagtgcctgcttcttcattttataaaaagaagtcctacctattcctaattcctgctgtacttccacatccttcttattataatgactgcaaaaacaggaatgaaggatttcactgagcatcacaccattcggtgcatagaacttcaccagtgtcattccacgatagatcatatctgacaagccataaagagaacatgaaatatcatcgtggaaccagttggaaagccaagctacgtgttgccgtggataaggcaatctggtcttctgtcaattacaatgagtttttacagaaaatgcagttggctggatatgaagtccgacagggaaaacatctttctttccgtgcaccagagcaaaaaaatttcacatatatgaaattactggggagttattatacggaagaaaatgtccgtacccgtctggagaaaaaccgttataaaaccaaagcaccaaaacatctgtcccaagaggctcgactatatatcaatatttccacgtatgtcactaccggtaactgggaaggatttgaacgttgggcaaaactcaataatctgaaagaagcggcacgcaccttcaattatctttccgaaaataatctgctaaactacgaagactttcagcagcatatttccgatatggaaaattctgttaaagcggctgagcagcggattgaagaaatcagtgcagaactgggtactcagagactcatccaaaagcattgcgattcttatcgactctgccgtaaggtaattgaagattgcaaatctgctaaaaatccaaaagcataccgggtcaaacatcaaacagaataccaactgcacgattcactaaaaaaagagcttcaggatctgggcgttaccaaaatccctagctctaaaaaaaccggaaacggattgaaaaccttgaatctaaacaggctgctactgtccgggagaaacaagaattgctgaaaaagcaaaagactttaaatatcattcgtcaaaatttcactgctctgcttagtgaacaaagttcacagatttacccttctcaacgagataatgtacaactataaaatgttttgctttagtcgactgatatgtaagaagaacactgactgcaaaatcagtgtccttctttcttcttttacatatatttcataatagtcggcaataatacattcatatctattggttttgcaacatgatcattcatgccacttgccaaagccatcttcttatcttcttcaaacgcatttgctgtcattgcaacaattggaatctgcgatttgttaccgtctttcagttctcgaattctcctggatgcttcatatccgttcataatcggcatctgaatatccatcagaatcagactgtagtaattttgctttgctttgttaaacatatcaatacatgcaacgccgttttccgctctttctatcatgattccctcttccgtcaaaagttccgttgcaatttctgcgttcaagtcattatcttctaccagaagaaccctttttccttccagttttttgatattcaactgaccgtctgcatgtttcggattcctttcttccgcatttgctatttttaatggaagcgtgattgtaaaagtagaacctgctcccggtttgctctgaactgtgatcttgccattcattaaatccaccagtttcttcacgattcccatgccaagtccgctaccttctattccgctgtctgacgaagatcgttcctgtgaaaatgattcaaaaatatgtttttggaattcttctgacattccgattccgttgtctgctatgataagctctaatacactccaaccttctttttcgccgggatattggttcaatgtacagcctatgttaccgccttcacccgtgtatttcacagcattactcaaaatgttaatcgtaatttcagatgatcttgcatcatccatatacaagtatggatatcgaatgttcttattgactttcagtgtttgatgtttttcttctatctgtttcctaaacatatcaatacataaatcaaagtttttagaaacatctgttattgtttcatccagcgttgctttgttgttttcgattcgtgctaattcaagaatgttatcaatcaaatgcagcattttctttccgcacaataatattttttcaaagtaatcttctaatatagttggctcctttaaatgtttctctcccaattctgcatatccaatgattgcattcataggggtacgaatatcatgagacatattaaatagaaatgttgattttgctttattagctgaatcggccagtcttgcagcttcctgcaacagtttttgctgtttctgctcattttctttttgcttcttatatgcagaatatccacaggtacataatattaacaaaatacacgctgtaatgcatcccagtacaatacttagcttattcgtcttctcaaccattccatacgctttctgcatatccatttctatgcagaaagcacctatcacttcattagattcatcttccgctgtcacaggataacaggctgtaaaaataggtccccatgttgtatcaacaatatcctgagaatatactatttttccagaaagtgctttttctatataaggaaccatctccttttcaatcggatctcctggatgtctgacgtcaccagccgatggatccagtccgtctacaacgtaaatcaatctaccgtcttcatttctggttgctgtgtaaatatatctcgtagaattcagcgttctgatttcattcatatatgtcgacatattcttgaatagttctgtattctcatcagctttactttttatttcattaaaatcttttcgtcccagtctgtcatttaccagcttatgaaccgcatctgcactggaaatatctcgttcaatttctgttttcagagcagttttggtatatgcttgttgtaaaataaaagtatatgcaacaacagccaaaatcaccattgccagaaggaataccaaccgtccctcaaaaattttccaatgatttaccggattttgatcttttcttttttgttttatatagttatttttcatcatcgtatttcacatgccttttccctaattttaatttaatacaaaaatgcctcaactcttcacgtattttgcaatatagtggttcagttgtcaagacaaaaatctaagcattttataatgaactgatatatgtaactgggtaggggagaaaatcccccctttctgtagtgtttacagtatgtcagattcattaagaaatgtctcttgaagtgtcttaaattacgataccattatagaatgcactgccgtaaagtgattgaagatttcaaatctgctaaaaatccaaacgcataccggaccaaacatcaagcagaataccaactccacgattcactaaaaaaagagcttcaggatctcggtgttaccaaaatcccaagctctaataaaatccagaagcggatagaaaatcttaaatctgaacaggctgctactgtccgtgaaaagcaggaattgcagaaaaagcagaagacactggatatcatcagacagaatttcacagcactgcttaatgctcctcaaatatcaaacaacgatatctctcgtaccgttgcatcctctcttcaacattagtgtttgcaacgttttaagacgtataatacaagaaaactgattccaccgcaatggatcagttttctttaaataatagctacttcatttttctcttttatagagtcctacaatcaaaccaagactaacaatcgctattaaaaaccatgcaactatatttgttgtatctccggtttttaccgtatttattattttctgaatagtatttggcttatccggttttgaaggtgtcgtatcctttggcttatctggattgctcggtggtgtttctgatgaaacccattcagcttttggctctatcgttacattatattctacattcccattaatttcagatgaaatattaacaaggaatggagcggattcaaatttatctgtaccactttctacatttccaatctgtgcaagcaggtaaattccttcatccaattctccaaaactcgtgcatcccgaagtatctgtttcttgcattaatccggaaatattattttctttcgcaaatgcaaacaattgttttgcttgtttctctcttgcttctgcactggtatcttgtaatgatatccctgaatctttaaaaccatcttcccatactaactcattatttttcatatattgaattggaaatatcgagaactttgctccggaaagagtcacttctttatccgaactatttctccctttataaataatttgaatgcttcctgttctacttcctgcttcagcatggattgttgaaatatctataaaattaccgacaagaaaaagcataacgaataaaataatgtgaatacttcttatcttctttctcaccttactttcctcctttttctatctcgtatactataaattatagctatcatcagccctatgaagattactacaattgttacaatcagcactttagcagtgaaagataactctggttttatattggtatcaggctcttgctttgttgcctcttcataaggtattctctctccacgaactaaaagtctatgtgtgttgattgcaaatggtgtacaagtaacaagtgttgcataatccttacctggttcaatggataagctatctgtctcttgtggcaaaaccgttaatatctgatcaatctgatatgccagggtttcatctaagactttaatgtaaaaaatatcccctacttccagtttatccatattggtaaatagtgtttttgtcggaagacctctatgtcctgtcagaactgtatgtgtactttctccacctacaggaagagatgtaccccagaaatgtccgacacctgcctgtagcacagcttcacttgttccgtgatagattggaagttctatattaatcttaggaatacgaatgtatcccatcattccagaaccatctacgttcaacagttcctcatagcgagcatctatttccacatcttcttgcgaaaatggatcaatcaaatcaatatttcccagcatttccttattgtatgctctcgcatcttccaacatctgctctttttctgccttacttaactttatactttcctcatcataataagatacaactttggaaccattcttttcgttcagataactactaaacgttggatataacaatacggagaatgcaaccaaaagcacgatcaaacgaataatatcttttattgttatcttcttttttttcttcttactcttcatttcattctccctgttgttatacttggaattgcggttaccttccgtggaagataaccgcccattccttaaatattatcttgtatctctggtaaaattattatgcttcttttctcttatcacggataaagcttactgctacaccgaatacaagaagagctgcgattacagcaaatgcaattgctccacgtccaccagtggatggaaggagggaacctgtgctgttttcgatatcgatgattttgtctttctcatctactccatctttggaaatagtccaattatttacatctgcatctgcactttttttgattgttactttaatcggagctgtcagcttgttgtatcctgctggagcctctgtctctacaagccagtaatctcctgctttaagaccatttacatgaaggttataattttccccttcaatacttgctactgattcaaatactgtattcttagatgttggatctactacatattttccatcgcttcctgaaaccgtaatagcgtttgttccagcttttgcatctgcctctgttgtataaaggctaaattttgcacctgccagctctttttcactagtcttttccttctttaaaatatccagtgggtaagtcggtgtctttgcttcacttggtgttgtttttgttgtttcctttggattattaccgtactctaactgagcattattcttttctgttacaactgcgtctttatttacttttgcataatatgtaacagtaaatgcttttcctttgtttgtctgattagctcttacccattcagataaatcaagagacatttttttcttgtttgttgaatcaagtgttgctgttgtaggtgctttgcttgcatctgcaatttcttctccaaatgctactgctacagtaactgttgtagcaccttcttcaagagctgttccatttgcatcatttacaaaatcaagacctttagataattcatcgtgaataatgtactgatactggtcatatcctgttgtatccgggattgcacctgttactgtatattttactacctgaccgatttctgctgtttctttgtctgctgtttttgtaatacttggtgcttctgtttttaagtttactgtagttgttgtctcatcaactgtaactaaagaagactgaatctcttttccacctgttacatatacaagatagtaaccagctgctaaattttcaaatgtataagatgttttattttcttctgtgatttttccagaatttgctgtagctgataatttctttgtcagtgcctctgcagtaaaatcatttgcaaacttctgtactgcaccttctgtatctttaagagctaaaacagctgctgcatactcctcatctgttgttcctgtaaatgatgttccaagggctgatttaatcgcatctttataaccagtttcagtattcactgtatatgcatagttctttgattctgttgtaccagactctgtcacatcaaataatttgtacagattaattgtctgacctttcagatcctgtgctggtgttgttgttttcacattaactgtaagtgtgagtgttcctgttgcaccttctgcggcaaatgctgtgacagacatagccatcatcataatcgctgccagcattaatgccatgatttttttcattctcttcataacaattgtctccttttcttgagaatttttcttttatagtttttctgcttttttattttccttgcattttttatatctcattacgaaatataccaggaaaagcagaacagctatcaggtaaatcaaataacttccgtatcctccggtatccggaagacctgggaaatgtctattagttattgtgaaggtaaatccatcttgcgatttatctatcgttgttgtataaccatccacttttgcttctgtgatggaatacgtgtaataataaatttcatctccatctgtcttgtatgccgggagttcctttatcacctcctgccatttagatttatcgatggaaccttctattttgtaactctcgtaacgtggaactgtttctgtcttttcatttcctgtcttatctttccaggtacgtgatattgttaccgtaatactgtttggtcttgaatgatcaaaattgtttaaatccttccaaactttattgatcgtcagcttgatgttctcatcacatggatcctgtgactcggatggttccggtgtatcactatctcccgtgttcaatgttgttttggtatctgacatcaatactgcttttgctggtgattcataagcattaagctctgctttcactgagtcacccttacttgccagaacagcattttttagagtctcaaaagtctttaccggattcatatgtcctattgtataaatatcccatccgcttgcatcatccttttcatgactgctgttcaagatactgttattctttttaatttcatctaaagattgatctaattttctgtaaatacggtaattattgttctcgccttccaccttatctaatgtattgaattgatattgcgaatccaattcactctttccgctaaacggtccgacaagattttttgttccacgaaccacatcacagtaatacatgttgttattcttcaaaagtccttcatcgttgaatccaacaaaaccaccacttcgtccatctttagcatcaccgtcattgtcatttccggctccaccggcatagacatcatacccatgactgacaccgtagacattactatcagtaattcttgttcgattggccttgatcagactcacactgatattggatttggcatcattatcattcaacaatccattttcgtcgcatcgaagtttgatggatgaatctccaatcgtaataattgcaagatctgtctcctggttgttatctgttgacttcttcgaaagtcccacagagatatccagtccgagcagatttacatgaagcagtttgccctcatacagtgcatccactttgataattccaagattgatcttcagaagattggaatcctggattttatccagatataatgcttttataagttcattaacaagcgagaatattacattcactgctccagaatccaacttcaaatctgcaagataagcgaaacttgttcgtcctgcaaatccgccggctgttccacctgacgctacctgtttcagtccaattttctggttcgtcttgtcacctgctgtacaattcgacattcttgcaagatttgcatatccgataaatcctccggcaatctgctcatctccatttgtactctgcacagtgtaaccctcatcagttcctgtaactgcacagtcatcaatgtgagaaccaaaaatgtccataactccaagagcaccaccaagcaactgtcctgtattgtctccaataacgtctatcttgtctgccttaactactccgctctttccagaatagccgacaaatcctccgacactattcaaacctcttacattacttaattctgttactttactgtttttcacagaaccatttagcaatgagccgccaaaacctccggctgttccgctatatgtaacctggttgttctgtccggattttattgctgtgtttgcgctgacacttaaaccagcatccttacttccgtttacagttccgtaatatacataacttctaaatgaatccagcacatcggttcttccaagctttaataatttatcaaggagcgaggtctcatttcctgcactgatattggcaactccggctacgtcagcaacaccgaagcatcctccggcatattcacctgctactacagaacgaatattctttacatgaataccagcttcaggtgtacccttttcaccaagaactgtaccttccagcattcctgcaaaacctcctgcagtttttgcgtaagaagtattattcttacctgttgtatatgcaccatttacgatatatccccagtcatcccaggattcaacatctgcataacgtattgtcgcaactgtcgcattaagtactttaataaggtctgcaggagtatcgagtagtttattaagaagcttacttaataatccttcacctgcagtagggttgagtgtagctacactaccaggtctagagcttcctacaaagccgcctacgtagcttctaccatctactcgtctgagtttcttaacctgacaatgtgcagtattgtcaccccagatttgtccaccaagaagtttaccgacatatccaccggcataaccacagttatccttattatcaattcctgtagattcaaccattaatccactctgatatccttctacagaagattgcttgataacaggtacaaacacattcagtacattgatcattcgtcctaaatcaagtttaagacctaaaatattcacaccaccaagatctgcagcaccaccattgatcatttctcctgcaaaaccacctgcagttctcataccagtgacacgttttgtctgatatgcctgaccatttgtgatagtacctgtctgcattgatccaacataaccgccagctgctccgccatttgccagttttgtctcatctcgataattaactcttcctgctacaacattgtatccgtaagcatactttcctatgatcgcatccagttcagcctgattagttactgttccatgctcagcaagatcacttccgtaaccaccttttttaccgacaaatttcacccatttgttccaggtttcataatccatctgggcaagtggtccataaactgccgtattttcttccgtcggatagacaacactgagtgctccaaggatgttatctacttttaccagtccccataataaggacagatttccggtacttgctgtatcggctgactccataagacctgtgaaaccaccagcaatttctcttccgtataccgaacggattcttactgctttacaagtacttgttggtccggtatattcttctttacctttccatttctttgtattgtttccccagatgtgaccgccttcattatgtcctgcataacctccggccatacctcgttgtacctgtgttgtggaagccgcatctgcacgaactgcaccaccacaaggaatacaagtcgtagagctgtttctgatcgtcggtacaaagtcctccgctaatgatgccaatgtatctgacacattaacaagaccatctaagataccagtatcgccaaggacatttgccacatttcctggctgcaagtctcccacataaccaccggctgtaatctggccaatgatataagaaaagttatttgcatttgaatcctgaatgtgcccaccagaaatctttccggcaaaaccacctgcatcaccaagtatgtcatttgctgatgcatcggatgctgtatttttccaagttgcttttactgcaaaacctctaacatctcctgtaacattcgaatgttctattgtagaaacaacgacattcaatgcatccagcacatttttgattcctattgagtgaccaagtacgctcaatccttttccaacagaagctgcggaaccaatattcatataaccaatatatccaccggcatatcttgcacccgttactgcatatgtactatcctgtctaaaataatttgaactatcttcaccctctaaatttttaggaggtgttacctttgtatattttaaatttgttacatcacaatgactaacttgaactccactgccataaccaataaagccaccagcactaccagaattcgtatcatccgatttgattttattagccgtaaccgtaaatccattatcggatttaactcctgcatattctattgttggaacatatgcatttactaagtttaacaactctccaatgtttatattcagcccatctatatttcctagaatactaatacctttactagcatcggccaatgctccagaataaacatttccaccaaagccacctgcataggtttgaccatttacagaatctaaattgtatactgcgtaataatcattagttcctcgtgaactgttatcaactgtaccactttgaaaatctgctgcaaaaccaccggcaacatctgctgtaacacttccaccattcacaaaagaaaccgtgcaatttgtatatttaggaattaaatatcctacggcatttactaaaccatttgtctctattaatgatttaatcgaattatcatcagcaacttctgctagaccacctgtttttgaaataccaataaatcctgaagcatatccgccattatctgcagccttcactgattttagatttgttacatgagaattttctatttttgtacttccgctttttgcgataaaaccagaagcactataatcacgaaccgaattagaatcacgactaccctttgcgtgtaccgtaaacccatccttaattccatttacatttgtatccttaatttttacttcaattgcttgtcctaaagaaagtaaattattcaatttcaacaaataattcaaacctaacaggttaacagttaatccaccatctgttccagccaaatcaccaggaccagaaagacctataaatccgcctactaagttattgccttctatagaagctaaattattgatactaacagttgttatagaaccaccaatcgcatctccaaatccaccggcaacacgttcatttcccgtaacagcaaatccattctctgcaccatttacatgaacattatctacagtaaacgcaagataagatgcaacgccaagcgttgtatttaataaaccggcaacactggccgtacccattgatccagcaattccaccaacataatcatttcctgtaacacttgataatcccgttaaagagctatcaatcacttgaacagaaccaacatcataaacattatttttccaatatgatattttctgtaaattatccgcattcgattgtgctatatatgcaccattacctcggcctattacaccaccaacatagtcctttccactaacttgcagtggagcatttacagaacatcctaagatatgtgatggattcacaccagcaagagaaagtaaagatgaagttgctccaggattactactcaaaagttttacaacaagatcaactacaccgccaagtaaattatcttttgtgtcatctttacctaggtctgcagcccatccaagagatgcaattcctgcaaaaccaccagcataatttccagaagctgttacagtgagtgcattatccgatttaacattacaattgacagttgatgcattggccaatcctccggcaaaaccaccaatataactttcaccagaaacagacacaactgcattatttaatgaacaatttagaagtaaactttccgtattcatcttaggaagttttgtctctatatccaatgcccctgatagtgttccttcaatcacatcatcacgagctagaccaacaaagccacctacaaaattctttccactaattgtattcgtaccacctgttacagaacaactctctacaatagcacccttttgcataccaataaatccaccggcatattctttatcggatgctgtagaaatagttaaactatttatattacaatttactatcttcggattgatatatcctgttggaattaactttcctaaaggaattgcgttccctaatagaatcttaattaaatcacctaagcctaaacctggaatgacatttaaaatatttgttaataatttaaccaaatcccctaaagcattcgataatccatcatattgagttgaaccaacggcatatccaacaaaaccacctgtatagccattcacattttttacatttgcattattgacttcaatatttgaaatttcaacctgcccttcaactcgcccagcaattactccagttgataaagctgtaggatcttttttacgtgcatctaaaacatcgcctaatgttttgcctaaatcaattttcacttgcccaaaagttaaaataaatgttaacccactcaacaatccacccaataactttcctagagtctgtgtaagtgcacttactaatgtgtctggataataggtttcatttgttgttgtatgaacttttagattatcaaattgaatattagatacctttaccaatcctttactaagaccaatatccttttcacttacttcacttgatattgttgaaaagaatccaacacccatttgttctccaacattaatcttagttgattgatctacagttacattcgataacactggtttatcagttgtatttaaaacattatctttccaaagtccacctttttctgcagatttagctccaatcattgttccttgaaaagtaagaggcttccactctttactgctcaaatctatatctcggaaaataatataatttgcgtttgctgtatatttctgtcctgttgttttgtctatatctaaatcagggtcaatttcacctgttatctgattgactccacacctgcctctggtatgtacccagctatgctgactgtatttgctatcagcatctttaatttgtccaaaagtaaaatctgctactccattctggtctcttgtcaaatcagcatcaccactataaagcatgatcggtttgccacttgaatctgtatcacgtttccataccaaaccatctagatatgcctgataaaccgcaccattaactcgttcatccgtaccaattttcctcagctgctgctcatttccaattaagatataggtcttatctccaatagtcttaacaacttgtcccttaaaatctcgaccttctgtaccttctgtactcactttactcaactgatctgcaaccagttctggtttatccgaattaaacttttgcgataacacataattatgagacttactataagtcagatacgccttatcttcaccatctggatagatcatctgccccataccaaactgtggtgcatcataatctaatgtcataacaggttctgtttcagattcttcctgtgcaagcaccatcaactgatacggattgtaaatgtagatggtatccgtttctttgtcatataaagtcggtgtttcattttcctcaacttctgttcctgtaatagttccggtaaaggaatctgacactgtccagatctgttcagaattcatctggatatcattcatcaaaatgtattgggcatctgcaccgtatttcagctctgtgccttcactatttactacatctccagaaccaatcttttcgtccttatcacccgtgtaaacataatcatctgaaccaatctgttttaattgttcataattataaatgcatattttactatccttataataagcatctatgttatctgttgattccgatttaacatttccaccggacgattccgattcgtcatttttcgagttttcacttgtttcctccgatatcttagattcggattccgtggtgccatttatttcatctgaaactgtggactcggttgatacttcaccattactcttattggcatcatcagaaagtgtcacttgactcgtgttggtacccgatggatttacgtctgccgcatccgcaatattcacttgagaaaataagatagccatacatagtattactgcgataattctgttctctatccttctttttttcttcatatctggacctctaatcttttgccttcacttgttactttaattttgcctttttaaccagttttgctgctttgctgcctcctgaaagcattgcatcagctgatttgaaaacgctccacattcaccatttgaaatcatctgtattgcctcttccggttcatatttccttttgtatgggcgatcattaatcaatgcatcgtaagcatccacaatcccaacgacctgtgcacacattggaattgcattccctttcaaaccgtccggatatcctgatccatcatatctttcatggtgatgtctgcatatttcatagctatattgattcagcttttccgttgttatcccttctgggaatctctgggtcatcgctgcacctactaatggatgttgctttactacattcatttcttcatccgtcaattttccatttttatttaaaatttcaattggtacttttatctttccaatatcatgaatcggtgccaaatgagctactgacgcaatttcttcatccgtaatcccgtattccggatattttttctgcaattgaagatatacctgtttcgtatagaaactgatgtcatcttggtaccctgcttcaactaaatgattatgattcaatacagtagttaaaagtgataccatatcccaatactgctttgtcatatcttgttctttttttatgagttctcgttccatctttataactgtgttctggacaattttctcattatgtaaggtaataattgcagtattctcatttgcatctatatatttttttgcttccatccaaacatatgcattcttatcttttccagtaattctgcgatatggaagatctttttccatacatccatcaactagtctttcttctaatccttcacttgataagaagtcatgaaccatttttttgtcagaagcatacacgtatctttctacatattggcttatgaactcttcatagctttctgttttccttactttctcatacacttcacggatatgtgaatatacacactcgtagcttttttccttcaagttcagttttaatacaacataaaatcgtccaaaatatgtatcttctaaatttctggaacaaaaacgatcttcttccaaacaacgattaattgccattgtttcctctacacacgatataatatccattaaagaaatgttctccagttgttttgccagcatgtagccaccatttgtaccttcacaggcagtgactatttttgcatctttcagtttttttgctattgccggaacataattagtagaaacatttagcttccgtgacaattctgatgtagataccatccgttcctgtgctgctaagtaacacacaattctaattgcgtaatctgtcgaattttttagttgcatcgttatccctctaacctaaactctgcgtggtcttagtttatattcaaaaaaatactatcctctgtagtagtgattcttttcctgaaatattttctcatcagtttcccaattatacagattaaaaccggttaatataatgtacaatcaatgaaaatatttatccgtttttttgtaaaatctgttccattgtatcgatattctccattaatatctttttatgaacttcgttcaaaaaaaagaaaccatgcctcaacacgatttttctttctttttctattctatttcttttaacattctataaataattagaccattactgactgccagcacttcatttgcattgtcaaaattaattccagaaatttgttttattttttcaagtctgtaagatatcgttctataatgaacaaacattgcacctgcagttttcttgatgctttggttatttctaagatacatctgcaaggttggaatcaattctcccttatgttcatcatcatataaatataatttctttaatgtttccggaatgcatctttccaattccgtcatatcatcaactttgtcgaatatctggaaaaatccgaggtttgaataatgtactactgacttactcttatcaccagtcacctggcggataatctcaatatacttgatagcctgacttgcttcgtgataagattctttcaatcgttgatacccttccacactttttcctataccaatctgaaagtctgtatctttctttctataaaggatgctttgctggataacctcctctatttcttccatctctttctgatattccagttctgtctgattggaatctacctgttgaatcataacaatctgatccatatttctgtaaataagcgcatccggcaaaagatgcatcaattcaccctcgataacccctacttcgtgaagctgttcttttgtatattttctttgtacattttttgtgatggtatgaaaatcaacaaccctgtaagtatcgctttctttcattccgagctgtgctgccgcttcagtcatttctttcgaactcagtaatccattcagaatattttggataatatctctctgatacgtctttttttcttcatcctgtgcaaattcactcaaaaatccatcctgtaagttaatagtcgcattttcgagttccatacaaacatcctgttctttttttcttagctcctgttctattgttacaatcgtattcggaatcacttttgtattatgaaatgtaataattgctgtattttcctttacatccacatacttactagctttcatccatacatacgatgtaccgttattttcgatgattccgcgatagaaaatttcttcttccacacatccatctacaagatgttctgttaaattctcacctgcaagacatttctggacatttagccagtctgcttcacaaatatatttttccgtatatttttttataaagtcatcatatgattctgctgtttttacttgttcatagacatcatgattatgagaataaatacattcataatctttttctctcagattaacttttataatcacataaaattttccaagatattcatccttaccaggacggataatgtctgatatctttacgctttccaagcggttattgtatatattttgcagatccagcagaatctgatgtactttacagcaggctatataatttttggagcaacctccctctttttccaggcacctgctaattgccatggtgggttctgtacacgatatcacatcccttaaagatatattctctggctgttttgcaatctgatatccaccctttatcccttcacaggcttttatgattcctgcttgttttaatttttttgttatttttggaatataactgtatggaacacttagttcctgagataattctgatgtagagatcatctggctttgcgctgccagataacatacgattctgatagcataatccgttgtacttgtaagctgcatagtttttacccctttccttatctaaactaaactatttcaagtattagttcgtcctaaaaaattggtgggttcctgtcggacgatgaaattgattattcaaaaatttccatcaatttcatcaagatatgggggtcgttctactctatcatcagatataagatctagaattctataaataataatatcgcaacatatagtaatgcgatgatggcttttcaatataattttttctcattgtctatttgaatcagagaatgtttctcatcaacatttctaaaattatataccattttcattttttttataatgttccaaacaggaaaagattttttatttttttgtaaaatctgttccatcgtaccgatactcttccctataatacttttttatgaacttcgttcaaaaaaagaaaccatgcctcaacacgatttctctttctttttctactctatttcttttaacattttataaataatcagaccattactgactgccagtacttcatttgcattgtcaaaatttattccagaaatttgttttattttttcaagcctgtaagatatcgttctataatgaacaaacattgcgtctgcagttttcctgatactttgcttatttctaagatacatctgcaaggttgtaatcaattctcccttatgttcatcatcatataaatataatttctttaatgtttccggaatgtatctttccagttccgtcacatcatcaatttcgccgaatatctggaaaaatccgaggttcgaataatgtactactgacttattcttatcaccagtcaccaggcggataatgtctatatacttgatagcccgacttgcttcgtgataagattctttcagccgttgatacccttccacactttttcctataccaatctgaaagtctgtatctttctttctataaaggatgcttcgctggataacatcctctacttcttccatctctttctgatactccagttctgtctgattggaatctacctgttgaatcataacaatctgatccatatttctgtaaataagcgcatccggcaaaagatacatcaattcacccacgataacacctacttcgtgaagctgttcttttgtatattttctttgtacattttttttgatggtatgaaaatcaacaaccctgtaagtatctctttctttcatgccgagctgtgctgccgcttcagtcatttctttcgaactcagtaatccattcagaatattatggataatatctctctgatacttctttttcacttcatcctgtgcaaattcactcaaaaatccatactgcaagttaataatcgcattctcgattgccatataatcaagttctatcagttctctattttcttctgtgattgttatatatatatccacctcactcaatatggcaaatttcactatatattgaacacagcttcctttcatctgcttcatatattgaaatttcgtaataatattgggtttatatggctgaatttcatctgacaatattaacttggagttgtccaagtttgttgaaaccatacaattaagattaccataatacaatacaacaggattctcgatcatgatgcttaaaaatttgataatatcacttgctgtattgcttgatccattattttttaaaataaacgtattaaaattatcatgtgtaattttaaaatactttaagcgtgcagtgtctttatcgaatacctgcatcataacatgacggataattccccagtaatataaatctcctggaatttctaccagaggaatttcatattttttgcagtgcttttctaataaactcaatctgcgtcctgtaggatcatattcttttcttttctttacaatgaatccacttatatcacttttaactaaatcttcaaaatgctgctctacttctcgatcactgcatgataaatatacctgaagactggttatgagtatttcaccacccgtcaggtatcgctccatatcttcaatttcgattattcgaatgcctttcacttccaaatctagacctttttcaccgcaaagcagcttcatttttggaaattgttctgattcaagtaattttcttacagtatatcccatcgttactccttatccattgccaaatcaatacaacataatatctgttatgttgtttatggacagattatttttcgtacgatataatgttaaataacaccctgctatctgttatgctgttcatattacatagttcctttctgattttttggtagctgtgccctatttaagtaccgcttttggtaaattggctataatctttattatttttattgcttaaagttatcttttagaggaaatgaatgacttgcagaaatagggtagaacaggttaatagaggcactgtacaacataacagatattatgttgtacattccaatatttcctgttcgacaatcttatccagcttcttttggaacactgtttctgtagttgctgtatatattctcgttacattgatactgctatgtccaagtaaatccgcaagacctgtaatatcttttgtcactttataataaatccttgcaaatagatgtcgaaaattatgcgggaatatttttgattctgctactcctgccttttcttttaatcgtttcatttctctccaaatattacttctgtcttttaacttcccatttttcgtgacaaatatccaaccttctgctacttggttattatggcaataggaaagaagtttcctttgcaataccttaggcaaaaaaatccttctatactttcctttattataaatctctatctttccagattttacacgctccactgtaaaatattttatttcactgatccggattcctgtacatgctattgtttcaatacacaatgcaagctgttcttttccttctgccatagctgttgcaatcaatttcctgcattctttttctgtcaattctttctgatcctgtaaaaaaggctgcttctgcacttttattcttttcactttcagctttcctacattcaaaaattccaggaactgattcaaggcggcaagcattgaattaacactattgacagcatatttttgagcaagccattctttatattgcaacaatacttttttattgatccgcttatcatctgccaaaaaagataaaaacttttttatatctgccatatatttattgattgttgcctttgcattttctttctggtatagataatctgcaaatttttctatctcactttctgatacctctattgaaaaatccatctgttccataatcatagtcctcctgagaattcattttctttcattatagctgttcgctttttcgtattcccatacactactttttctacttgttatgtatccacggtttttcaatatttatctccaattatatatcgtattgttgattttagtcaacagtaggcgattatttttatcatcgattgtggatataatttaacaatacgagaggagatgttttatactaatgtcggatagcgaattatgtttacaggaaattggaaaaagaattatggatcgtcgaaaaaagctgggactcactcaagaagcacttgcagaaaaaggtgaagtcactacccagtttgtttcttatgctgaatcagggaagcgagcaatgaggcctgaaaatctgctaaaaatctcctctgctttagaagtaagtgccgattatttactcactggtgaaattatagataaggatctgttgattctttcagataagctccgccgactcactccttcacaggtacgcacagttgaagctattatagatgaatgtaacaacctttttaatcagaaagaaattacccttctctctcaaaaaaggaatggaagctactaaaacagttaatgacattgcgtatttataaagttttttgccgtgcagaaataaaaaaccttgaggtacaagctgatttttgctcatatctcaaggtttaatttctttttgttggtcgctaatcatttttacccttttcaggataattatatttgcaccttaacattcaagttgctcaaactcctttgcgtactgcgtttcatgacacgcaaaggcttgatgttgtatcataaggaggatgacagctccatctaaatttatcgaacaagctataccatttcaactcacatcctcacaaggaggatgaccggaaattatacagaaacgtatcgaacagaccatatttcaactcacatcctcacaaggaggatgacggcgagaactcttggaatcgttatattcttttttatatttcaactcacatcctcacaaggaggatgacctcgttctgctgctttctcatcccagctgtatgactatttcaactcacatcctcacaaggaggatgactctatttctgtgccggcactggacaagatatatatttcaactcacatcctcacaaggaggatgactactgattctcatagttgttcttatcgcaagatatttcaactcacatcctcacaaggaggatgacgataaatactattagtatgaaaatattattagatatttcaactcacatcctcacaaggaggatgactatagtctatcataaccgtacatgtagctttgacatttcaactcacatcctcacaaggaggatgacaaatcagagaaacgattgcaacgctgaaagatgcatttcaactcacatcctcacaaggaggatgacggtagatggctctataccatctttctaggcagtttatttcaactcacatcctcacaaggaggatgacttgttttcttttttttgtcttcttcgtcagcatcgtttatttcaactcacatcctcacaaggaggatgacagtttccgctgctattgttgcatctgtatcatgtccatatttcaactcacatcctcacaaggaggatgactgacttacaaggaccaaaaggtgagaaaggagatatttcaactcacatcctcacaaggaggatgaccttttatacatgggagtggatgaggaatgactgtatttcaactcacatcctcacaaggaggatgacagcatctaatttcgtattaggaattaatagtggaatttcaactcacatcctcacaaggaggatgaccatacgaaaacagtgagcgaaaactgtggcattatatttcaactcacatcctcacaaggaggatgacgatattcatcccatgtacttccattgaaaattttatttcaactcacatcctcacaaggaggatgacccggcaagattcctaattccttgatgaaggtagtatttcaactcacatcctcacaaggaggatgacggatcacatagcttccgctttccatcttgatataatttcaactcacatcctcacaaggaggatgacctactggatttcctggcattttaagtacaaaggtacatttcaactcacatcctcacaaggaggatgacgtaacatattcatgtccgctgaacaagggagatatttcaactcacatcctcacaaggaggatgacgtatatccaaatacacacccttgaatattttcacatttcaactcacatcctcacaaggaggatgaccgttaggtaatttcatataatcacaccttccttatttcaactcacatcctcacaaggaggatgacggcggaaatctgtacatacttagaatctttgttatttcaactcacatcctcacaaggaggatgactactgcacaattttagcttcttccggaacgataacatttcaactcacatcctcacaaggaggatgaccgtttctttttcttctttttcttctttttcttctatttcaactcacatcctcacaaggaggatgactatggtggtggcaagacttaccagttcactcttacatttcaactcacatcctcacaaggaggatgacttcaggtacttgatagcctccgagaacgagaatatttcaactcacatcctcacaaggaggatgacatcaatgttgttcgctctcggaacctttacatacatttcaactcacatcctcacaaggaggatgacgctattagcggcagcaatacatttgcatgacttacatttcaactcacatcctcacaaggaggatgaccttgacgaaagatacgcaattggacatggcattagaatttcaactcacatcctcacaaggaggatgacgaatacttcagttgcacaagacactcaacaggtcgtatttcaactcacatcctcacaaggaggatgactcttcagtggggtaaagatattgttaacggtattgcatttcaactcacatcctcacaaggaggatgacagcaattttaaacaaaaatactctatttaaaatcacattttatatcaacaatagacattttatatctattgttgacatcttttttcattttcatatatatttctaagcctaatttttctccttttctggtgcgaatgtcctagaaaatttatgtgcacttatcattcgcactagaatatcaacatatcctgaacatcaaaaccagacttagcaccaatatgttctactttatttttatatttttcacccagataataaaatctaaggctatctacctctttatctataatgttctccaatatattttttacttgtctacatttggttgcatccatttgacattcaaatacagaattctgtactctctgtccgtaattagtgcattcttttgcaacctttctcaaccgtctcctccctgctgctgtttgagtatttacatcatatgtaattaaaactaacatctgctctcctacttccagaaaaatggtggatactcatctaaatctcctctcaaacatctggctaatagcatactttgaacataaggagccattccccactctattttttcatctataaaaggatgttttatagtttcctgttttttagattgccacgctgataagaaaacttttctcccttcatctgtcataataactgcatcattttcttttcttataaaatatttttctttcataatttttttattaatcagtgtcaatacaaatctatccaccataatacctctaaattcttccataagatctaatgctaatgacattcgaccgggacggtctgtatgaaaaaaacctacatatgggtccaatcctactgcttccagtgctcctccgcacatcccagctaatagggaatatccaaatgacaacattgcatttacattatccaatggcggtcttttatttctcccatggaaataaaaattgtctttttgctgcaaaatcaaatcgtcaaataccgaaaaatatactgaagctgcttctccttctagtccaagtagttcctctgcattttcacattctcttatttttcccatgctctgagctaaaaacactgactttttctttatcgtttccacatctaaacgcagcgcataatctcttgcagctctctccagaatccaccttgaattatatacttttccaagaataaaatttcttgctatatgtacactttcatcccgattatcactgattctatattgttgttttcttaatgtaacattcccttttacttcacctgtaactcgggctagaaatcttccatttccagacataaaagacaaatcaatattcctctgtgcacatactcccataagtgccggactcgctcctgtatagccaaatgtaattatcgcttgtaaattatgtaatggaattcttccgatttctttttgatcttccaatacaacaacattttctccatctaaggacaaatatttatttccagatgtcacatacaacgtatttaaaagtcttttcatcctttttcctcttctgaaataattttatcaatatatccggaaactgactttttcttatttagaacaggtagacaaatgtcttttaatgagcatgcattacattttttacttattttcacttttggagtataacattgcgcgtaatacttgtgcatttccgcaaatatttttctgactttatcgcgtatttcatccgtaaattctacttttgcacgatgctttgtctctccataataaatatagccatatggtattgtgcaacacaacatttcttctaaacataatgcctgtgccgttacttgaaggatatcggaatcatccgtttttggttttcctcttttatattctatcggaaccactttataaaatccttcttttccggacaaactgattccatcctttgctttatgaaattctaccacatcacattcaccgctcactcccatttcccgggagtgaatcggcattgctctcacaactatcaaatcgcctcttttttctttaatacttgcatcgtgagcattttcatgaagaatcttaccttccactgttctgacattttcttgccactgtagttctatatacgctagtgcccattgtctcctgcaaaattcaaaatgctgaattcctgataattgaagaaagtcttcttccttatacaaattaaaattcctccggttgtttgcatccttctacatcccatgaaatctcataatcctcgaattctctcggatgttctttttttgcttcaatagtgaatcctctttgaattttaccactggaaactgccggtgttttttcatcatgctgccaccagtacattttgcaaacttccatacttccttccggtcttgcagaagacgcatcattctcaaataatgtctttaatgcttcttttaatacttccgcatcttcctgactaaaacctgttttttcagcaagttgtacatttacacttcccattaccttatatacagcaaatccaactctgtgttttgttcccatcgtatcagatgctttactttcttttccagattcactattcacactttttgtaatctgcatactgataatatcgattggtgataaacttactgcctgatgaatagaaacaggtccccgtaccccgaaagacaccggaattcctttaaatgcaaagacttgtccaaaagctcttacatctaaccattctttgcatgcaattgctgcacaagcatcacgatttgcatttttcttatttcccatctctgcttttaattcctcacagctatctgctcggtcttttaaactggtataagcatcatctgttctatcatctgactgaacaaaaatcttttgtcctaaatcctgaaaacgatttctaatttttctcttaatacatacatctgaaatttctccaaaaccatccatattaattcgcggacggtttccgtttaatggatctccgtttgggttggcattgtttgcactgataaataatgtgaaatcaatttttccttttaattcgctcatggtctactcctcctctttttactcttctgaactttcttctttttcttcagacttctctttctttaatttcaaatcatatgcctgattatggaaaccaagtagatataaaccttctaatctactgttatcagtaaatgtgcttttatcaaacagctcatcaatttcatgcaatagattttcgtaaaatgtcctttttgcaatatctagcttgttcaaatatggtcgaatattttcctctataactttccacgtttcatatggtctttgagagaaagtgctcatatatctttttgcatttgtaactcttccattatctttctcgtcatatgtcaaatattcaattcgatctgcaactgccagcagtcttccatacagataatttctatctgtttcctttttatctaatgccacgttccattcctccttatatctatcctttttatccttttttacaaacgaacatgctaatgtcaaaactctttcccaatttcttcgttccttatatgctaatggattggatgcctttgatactgcaagcatcacataatcatacggaaccaccctagtgccattccatatacatggaagcaatctttgagctacttgtgcatagagttttttaccattggcatccactatagacaccgttcccttattctcaataccgtataaaatatctgcaatatctttaacaccaaccattcccgcaaattgtattctttctccatctttccattttgtatgaatccagttacaatcgttatgccatttttctatatttttcagatatctgacagaattcagctcttgattttcaatcaacgctaatcttcccggtgttgctgcatcaaaagcaagcaaaatcatattcgaagtattatctatcttttttccatagcctcttagtgccttatagaacttatcggcggtgattggatttccatcggatacaatctcccctgtagaccagtcatcttcccaatcatcctcagcatttccaacatattccctttcatactcagatacaattgcctctgtatctctctcccattttggcatacttaattgatttgactcccatgtcacaattgtcatagtatcgaaaaaagtgccttgttttcgaataatccacttcaaagcattgtgcgctttttgcgaggtctcatttcctactgcaaatgcctcttccttacttgtaaaacgtcctcgataggtgaaattttgactgtcatttgcagaaatcagctttgctccatcaccttcatttctgattttctttgaatgaagataagaaatagattccatatttccagtcagataacatagacctttttctttttcctgtgacctgacatattctatataacattcctgcaacgctctgtctttccaacattcatccggagtttcctgataaagtttttcatcaaaagatcgtataataaatcgtacaaaagcttttggctgtggaattccttgaatattttctttctcatctatttgattttcttcattaagttttataattttatgtgcaattaaatcttgaattaatgtcgattttttcaaatacttataaattgctctgaccttttcatgacaataatcggattctacccatttttcaagctgtgaaatatatagctcgctacatactccatcgtctttataatattttttatagtcaccggcaagatatctcaaattatcacataatggatgtggctcttttccttttcctgtacgacttccagatttttctgtaaccggtataatcgtcgttttgtctttctgttccacttgctctgcacgaataaaatcacctgcttgatcaatcgttaccgttatctgcgccgttacagttgtatgaaatagcggaagaagtacataagggatgtctcttcgatattcgatgataccaattttatctgtatttttctcatacaaatcaatcaattcatttatccagctcaatcttccacctcctcatctgtaaattcttctaatcccacaaaattattcacttcttttccaaatacttttctttccattggacggatatgtcttttctccgtacaatcctccggtctggtaaattctataattccaccctttttcattaccggcctccagaaacgcactgtcatctgatctttatcctcttccagaatcgcctcttccgcataagtaatcccatgatacataaatccataacccacttccccaggcatcgtatcataataactcttgtcttcgccaaatacacacggttccacaaatgcctgacattctcttgttcctaagaaaatatctctgcgaccacctcgttttaccatccttttcgcaatattatgatgcttgttttcatttctatcctgctccagctccggatgattgagattcatctcaaaatgtgcccgcacctgatatctcacatcttttaaataagtataatatgccagttcatttctaccattgtatgcaatcggtcggattcctttagtctcagtctgaattggattcattactcttaccgcgtcaatgatccaaataatcgtaggcttccagtaaatactttccgtaattccttttaatgcttcgtaagtcggaatatgatagcttgtcttttctcctcccactctcataaccggatctgaaaaaagcgcatatgttccatgcacttcaaactctattgtatttctgtatctttccaaaaatctcacctcctctataacatttgcaattccatattaggttcatccacaacacctacttccttgtcataatatccatcacacaataccaatatctctccattgccaatttcatatatagcatttccgagtttttcttttcttttttcagaaattccaactgtatatctctgcaatttttttaaaatctttttctgctcttctatctcgagataatcctgcgataatttatccaatagttctctcgcttcatcattgtatggaaccacaacactaactttataatcattagaaataacttcaaacgcctgtcctgcggtcaaaaaagcctgcggtaattttgtctttactttttctccattccttctgatatattgcaattgtcctactttattttctcccaataactctataatcgtggttgtttgtttatctatcaaaaatttcgtttcatttgttctaagttgggaatagtaatttaaataatatgcttttattgcctcttctgaatccaatgtatctctgaattttaaagaattatttttataatcttccaatactttttgtaatgctgcctgcgcatttctaatttcctgcaaatgacttaatttctctgctttttcggacatctgtacaatgaaaacagttcccattcttcctaattccttatgtctattgcatcgtcctgctgcctgaattatattatccaaacctgctttagacctcacaacacacccgaatgaaaaattcactcctgcttcaacaacctgtgtacttacacatataatctttttcgattgttcattcaaaatttgttttatagattttaatgtatctaatttatgttgtggacacatattattactcaaatgaaaaagttcatattcttgtgtacatatcgcttttaattgttgaaatgtattcattgcacaagccgtagtattcaaaataaccaatgtactttgatattgttctgttttttccttcacaaattcacttaaatcttctatctccataccgccaggatataattctgttgcatctttaatatctgtccttttaaaagcatttgcatacttttccggtcttcccgccatttctatacattcacaaatgttattctcttttattggtgccaatgttggctgcgttgctgaacacaacacaactgtcgtaccccaaaattgagtaagaaaattcacagctaaattgaaaagttccatacattttacaggaattgcctgcacctcatcaaatatgataatactgttacataatgtgtgcattctacggatacagcttttctgagctgaaaacaatgtattcaaaatctgtactgccgtggtcactataatcggtgaatcccaagtttcagtgagtttgcgataccgctcttcttttccatcttcgcaaaccacattacaatgatgctccaatacaatatccgccttgcctattgcttttcgaatctcctctgcattctgaatcaatatagaattgaatggtgctatataaataatatgttgttttttcgtctttttggcatgatataaagcaaaacgcaaactgctgagtgtttttcccgctcctgtcggtacagtaagtcggtaaagattttgttctttgtctgcagcttgtctacacaaatccgaaatttcttgacgaaaagtatttaacacatttccatttgatggattattttgaatttcctttgacatatattgctcaaaattttctatacattcattccaaatcttctgcgtctcttccaatgaaattctttttgataacggaacatcttgaaaaaaacaagccgtatccgtccagtccccatcaataagtaaagataaaactattctcagatacattcccataaagaaatatctgttcccacattttctttttgatatttctgactctttatgaaaagtattgatttttccttccatttccttatatgtttgaattgcttttttgcagtattctactaatatctctttatcataaatctgaaagaattctttctttatccagtcataatctatttgtttttcatcccgttgttgctgtaaactttgtccattatctagattgatgcaatctcccattccgtgatgaaaatatataaccgtactgataaattctgaaacacttttttctttgaacaactccttgattaatcttccgccagcagtagaatgatctaaaccatgtttatgagcatcatccccatattggagaatcttctcaaaatcttcttgattttctcttcccagctttcccacatcatgaaacacccctatcaagctaaccaatatcttcaattctgaaagagaacaagtctccgctgcatagttcgcaacattttccgaatgctctttcattgtctgatatctacctgattcatagtctacgtgcgccaaatctctttttatttcgattttattttccatttatctctcttgtgttatctgtgtatatttttctttattcagttttctattttatatatttttactatattttatcaaattaaagaatgccatacaaggcagaatctaagaaagcattcgctttataaaatatcaaaggattctactttgctcatttccctgtttcatcactacaactccattttccctagtgcaacgcctttgttggacaagcttttgtgcattcatagcaaagaatgcattcagttccattttttcgctttcgggattctttattaacttccacgttcataggacagactctcaagcatttgtcacaatgaatacatttactctcgtcacaatgaacacgtaaaaatgaaaaataactcataggcttgaggaatactataacaggacacagatatttgcagaatgcacgattatccttgagtacaaatgccagtccgatacccaaaatataataaagcacatttcctacgatgaacagccaaaacataatttgttccagctttgcaatttttatcagcatcaaaccggataccaacgctaatgacagtacaaacatcacatagcgaagaaaaccaagcttctcttttcgtggctgttgcggctgtttgtaaggtagaaaatccagcaccatggctgtccagcaggcatagccacaccaaccgcgcccaaaaaacaatggaccaaatattttcgccacagcataatggatagttgccgcttcaaaaacgcctaagaacagataataccagaatccctcaatctgcatattttcatgggaaatcacaccgagatacaacaacatatagcttcccaccgccaattgtatgaaatgtctggcatactgttttccggcggtaaatagtgctgttcccagtccaaggcagcctcctatgtagctaaaatttaatagataaaatagatttttcttaacaagccacaatgtaactgccactatctcaaatagcagaaatagcaaaattgatggcacatatttgcgaaacttgtttcttttaattgcttctttttgtgcgggtttgctctgaactcttttatctttattcatagaggcctccttatcatttagctttcattcttgattatacattccgccccatggtttcagcaagtgaggaaatagaaaactctggctttaatgaactatgagccaaagagtaaaggacttgccctaatcttttattatcagcttcaaactctattttcatacgatgactgtacttatagcctttaaatcttcgcttccagctcttatctctgtcctgatagctttcatattctgtatcgacattaaaatatactgttttaaggtcttttctctgaaagccaagtttttcaaacaaatccttgaggagctctgtatcttctgttgaccttcggagagtatcttcatattctttgcaaagttcttccttgctgacatataaccggatcatatccggctttactgctattttaccttttcccgtaactttaattgttctcattatctttgctcttccttttaaaaccgctatcatcttctttgtcatctgaatatacttaccaaatggattaatcacaattccattaatcttttccccttcttctcatctgaatcagcatttttatctctaccaagagtatgatcaaactcatcaagaacatccgtcatcaagccttcatcaatccggcttctacactctgcaatcaatacagccggaattccataaaatgcttctgcaatactgcctgtgatagcaccaagcgtgtcagtatctccacctagtgatactgcattccgtatggcatcctcaaaatctttggattccagaaatgcaataattgcctccggtactgttctctgacaagtctcatccatatgatatcccggtctgatctcatcaagtgttctatcaagattgtaatgaaactccctctcgatgtattctttaatttcttcttttgaaaatccattcctagccatgtatattgcactggctgttgcttctgcacccttaatgccttccggatgattatgtgtcacatttgctgtcgctcttgctacctctcttgttctttccagcgaatcataaagccatcccgccgctgacactctcatggcggatccattcccataacttccgtatggctctgggttgctttctctaagccaatacctgaatcttccaccataacctgcatatggatatctttttccccaatcctgcatgttagttactagcgcctcttctatttcctttactgtagcttccgttccgactgcaagaagagcttctccaactgctattgtcataacagaatcatctgtaaagtcacagcctttagtaaacaaatcgaattcctttgttttatttcctctgtcaaactcaaatggacttcctataatatctcctaaaattgctccgtacatatatgcctccaatctccggattgctccggcagctctttttctttgttacaatataagtatagttgagcggcatctttatatggtcgctgtctgggcgacactttttaggacaaaagcaaacgccgatactacaagtatcgacgtaacatatgccaatcaatatttacttgtaacctctttatactcccaatatttcattcgtatacttaaacaaagtcacattcaactgcataatatcatactgcttatcaatgatagccttctgtacaatcagatccaccttactgcttggactaaatgcccaatctgctctggcaagtaaatcttttgactgttccaggtcaagccgcagtgcgatacagagtgccatcacagttttcttctttggatgatagttctggtcacactgaatctttgaaaaatgtttcctgtcaagatttgcccgtttccacacatctttattatcaagatgtgcttcgtcaatcagttcaaataatttatcatgaaaggaagctcctatattggccagctggtcttccaatgaaatattttctaacggcatgagtaactctgtcatgcctgtatctgtcattttctcaagtagatagttgtcttcttctctttgaagcatttcttcattgaaatcttcttctgccaattcttttatacgagtacttcttctgctccttatcgggtactcttttctatggatttctctgacgtaattagcatctatataagaatcaatatccccaacaatctgaccggacagctgaaaagaccttttatcaaacactaccagtatgatttccatttcattttcagtaagaaactggctgaatactgacacagcaatctgtaatgccttgttcttcggaaatccatatactcctgtcgaaatcaggggaaatgctatactctcacactcaagtttcaatgctttctgtaacgattttcgataacaattctcaaggatttcaaattcatgatgctttccgtctgtccataccggtcctactgtatgaataatatattttgcctttaagttgtatgcaccggtaacagcaatatcacctcttgcaattttgccgatacctgctctttcggcaagaagctgttcttttcctgccgcctcatatatggctaaatctgtaccgcttgcacatatcggattcgggttggcagtatttacaatcacatctgctttaacttttgttatatcgttacggacaatcttaaatggcatcgtgacacctcctagtattacaactctgtataagatatctgatattcaaacaaccgcattctcttatcattatgccctcttaaaataagttcctttgtcagattgttcaaacaaataatcccatatacttttttacctttgaatttttcacttttctcaaaccattcgaggtactgaaccgtctgttcataagcatcatcatagccactgtccttcttcaattcgacaacatacaaatttccttgattatcctcacataataaatcaagtcttccaactggaataatatattgtctgccatactcacctttacgtttatactctttaaggttcataccaaatactgacatatcactttctattcttgcagtaagctcattttctaacaacttttcattagagaactgctgtcgttttatcccaatgtctattgtaactttttcagcactgtcagtatcatcaatatctgattcaactgctacatcacacttcttcaaccttgcattgtgattatccagctttttcactctgtcacgaataactttagcgacattaaatcgggttactaccgtatcgtatgcgttttttgttctccttttctgctaaaaataaaaaaacacagataagatacatcaagccttgtttgtgtcatttttcggggcgaaaataaggtaaatatccctttctaagcctttccgaaaatcgcataaggtatttgtactaacctgtggttatgtattgaattataggttttttgtatataagttggaagtgaaactcgtgttatcagagagttatcagtctcaaattcgtgataagcatcaaaatgagaaataatataatcaccacgagtaactggcaaaatagagagttcattatccgcaaaaatccttggtaaattaattgtatggtcaaacttcgccatcagtcgtggctctcgtacttcctttatctgctttgctgagatttgaaattgcccagttctctcaatatgtcctaatatatcgtacttctcaaatagtttttcccacgctatgtcattaagacttttttgacgatcacttataattacgcaccaccacttcgtcaacatctccacgctttgaagcgactgaattaacagcacgtttcgctttaacaatggttatgttgtaagctgcatattgctccaatataaattctgttgcagaatttgaaagcataaactttatgccacgagcatttaaatcatcacaacactctctcagtcttatttgatcttctcgtgaaaatccacctctcgagtatccggtaaaacttgcagtttcagaaacaggatcataagggggatcaagatacacaaaagcaccccttggaacatttttcaatacttcggcatagtccattgtcgtcatacgaatatcagcagaattaaaatatgcactaacagccctcaatacaggtgcattcacaatattaggatttcggtaattaccaaacggagaattaaactcacctgcattatttacacgatacaatccattaaaacaagttttattcaaatataatactcgagcagctttttgaacatcagtcaatgtcaaataataatccttattgcgatctcagtctctaactgcatagaactgttcagctgtattttcaaatttctctaactcttcaatcagttcatcaacattttctttgataaccgtatatacacgaattaattctggatttatatcgtttatatatgccgtattaggctgaagatgaaacaacaatgcaccgccaccaacaaatggctcacagtatgttgtaattttttttggtaacagtgggcgaaaagtatccaataattgtctcttcccacctacccattttagaacaggggctaccagtttattctttctcattttgccaacccctttctttgcttcgttttttacataaaaattcattttaaattataccacctttttgctaaaattcaattacctgctactgtcaaatagggttgtttcatgaagctttcaccctatgcaggcatgggtagatgttgaagatagcttagatgtatggtaaattaatggtgaatacttctagtggattaaggatgaatatgtggtagaataacccatatggtagacttgtttaagagactaccatatcggaatttacgcgaggtgcattgatgaaacaactattgaaaatagatttacaaaattatgaaaattgcgatagcgtatttagtagaccatctgtaagaggaattattctcaaagataatagcaaaattacacttgtttacagtgagaaggaaaaatattacaaatttccaggtggagggattcacaaggatgaaataagaaagaagctcttattcgggaggttagggaagaggttgggttaactgttattccggaatctatatgtgaatttggaagtgtaatgcgtaggcaaaaaagcaacgtttcgccaaatacaatttttgagcaggaaaatttttactatatgtgtaaaacaaaaaatcggattgtagaccaagacttagatgattatgaagcagaagcaggatttacgcttaggtttgttagcttggatgaggcaattcgtgttaattcagcatataaaagtgaagattattttaatgaaatcatgattatgagagaaacaaaagtgttacagatgattaaagacgcaattcactgaaatcaaataaaaagattgtagctgttcagagcagaccgaatcacttgctgatgaggtcgtaagaacatgattcgtaaaatttaaaaggacataggtaaaatgagcttaataaaaaatgatataccaattttagaatatgacacaaacagcaaggctgttattatgccaggacacagtacgaattttcattttccggagagagcagtaatgctgtttatggaaacagagattgacgattatgctatgacaaataaatgcgagattatcggacagtttattagtatcacaaaagtctttcctgtatataaaacggtacataatggtgttgagttggcaatttgtcaagctcctttaggtggggctgcttccacacaaattatggaacagctgattgcgggtggtgttaaaaaggttatagccacaggctgttgtggtgctttagttgcagataacgagggggatttttatatccctacctcagcactacggcaagaaggtacatcttatcattatctaccaccttcacgagaagtcatgcttaatcaatcagcaataaatgcgattgagaaaatcttaatcaatcacaaatacaactatcaaaaatgcaaaacatggacgacagacggattttatcgtgaaacaaaagaaatggtggaatatcgcaaagaggaaggtttttctgttgtagaaatggagtgtgcttctctggctgcttgcgcagagttccgaaatataattttcggtcagttattgtttacggcagattcacttgcaaatatagaatcacacgataccagaaattggggtaataatacttttgcgttagctatgaatttggcaatggacgctgtaacggaggtgcagtaatgcaaacagaaaaagaaatgtctgtattggaagcgacaaaatcgggcatgattttaggaattttttgaaattattttttgaagtgtaaaaagacataaaaaaagatgccaggattcctcctgacaccgtagtaactgtgccaacttcgtgcccagtgggcacaaggttggttcatctcatcatatactgttgtaatttgaactaccccaaccgactaacgtcggatggggattcctacgggctttcgcccgatacccactcgttcagctcatgggtgttccaacagagaacaaacccgttttcaggaatgtttttgtatgttggcgtaagtcagatattcccgtccatccagctccctgcccactcattcaactgactggtacaaagtgactggtaagaatatccgaatatttcttctatttctatatttttatatttcgctttttcttttttctatcttcttttatacatactcatatcgattattttgcgtccattttttcatttccgatgcaatgctttttaatgttcctttttttctttcttctaagacttcataaggcagttcccggtaaaaactatggggcgaaactccacgaaatgcttttgttaactgtttccatgctggaatgatactcacaatatcggttccattttttagtttttcttttgccttttctggtaataacacaagtaaccgctcatccggtaacagtttttcccgaattcccattccttttaatccaatcgtatacgatgctgcttcatgaatggaaagtccaaatggtcttaaatacaaaaacttccccatttggctggtataagccggattcattttatagattccaaaactttgtttataggcttgattttccaaacaggtcgtcatttttcggtaagcaaacaaagaagcatgtcgattctttttcttacatccatacttcattccgtgttttgcaagcgtggtatccaaatcttccataataagcggtttcttccgttcggcgcaataacgtcctacctttgccatcactcttccgatttcttctgaaatctgcccttttgttttcaattccggtgaaaaacgaatgactgtcccacccagacggtttcctttttcatctaattctgaaactgctacatggtcataattcaaatcaatcgaaacacagccttttttcaaagattcattgcaatatttattttccagtaaaagcgtcaccgatacaatcagatatcttcgaccagttttctctcgtttcaactgaaaattataacaaatcgcttttcgttcctgtttttttgcctgaagcatttcttcccaaagttcctgttgccttgcaagatggaactgtttaaataccgtttcttttccatccatacattttacaatcaaatttctttcttcttttctgaccagaaagttacagttttttgaagtatgacgtcccggaaggctcattgaagcatggcgggattcaaagaattcctgtttccactgttcacgatcgacttttggattgtctttcttttgatattgttttcttccaccaaatacaattctcttcggtggaaacttttttaaccattccagcctttgaatggctcttttcttagaagattccattaatgcaattcttgttttcaatcgacgaatggaacgttctatttttctttcgtattcttcggctggaaagtaggttccatttggaagaaaaatttggtttcgttccattgtaattcgacactttggataaggacgctcccagattccgcttttaaaataagttcgcagagaagatttgattccctgcttcttttccaattcttcctgtgttcgttttatcttttgattccgtgtctcaatatctttttcttttgttctctgatacaatcggttcaattccttttgagaagaaagaacagaagacgcataagtatagatggcacaattataatagtccgttgttccatagttccttttcagccaggagctgtaggttccttctaataacggacctctttttaaaaaggatttgtcatacaagcagttatagagcttgattttgatatgattaaatcgttccatcgtctgaatcaaagactctacgttctggatttcatcctcatccagataataccgcttatctgcatttatcgttctggttaactgcatgaaaacactccttttctcaaaacggtttgtcggttaaaaatataacaataattgaaacaaccctttatttatagtataattatagcacgaatcaagccgttttacaacatcggttattttaaagaaaggagaaatttatggacaacaaaacttataccagaaatgctcattccatctgctgtctgacctatcatgctgtttttgtcattaaatatcgaagaaaagtaatcactccagaaatccttgcttttatgcgtagtcacacagattacttaatttcacagcgttatcatggaaaacttttggaatttaatggtgaagaagaccacctccatatcctatttgaacttccgccatccgctgcaccttctgttattatctgtaatttaaagactcagctttcaaaggaagtccgaaaacgcttctgggaacaaattcacaatcaattatggaaagattctttttggagtgacagttacttcttatcgacaactggcggtgcaaatttggaagtattagaacaatatattcaacaacaaggaatcgaaaaacaaaaacggaaatacgttcatcacaagaaaaaatgagcattcatccccaaccgactcgtcggatggggttttctgctctatagtagataaacgccactcatctttattacttacaatgctttttattagtattttagttctttgataatgtacagtatcatctatcacaatacggataatacccacaggagtattggttcgttgcgactacgaaaatgatacaattaaacgatgcaccccctgtgaacacccctacacaaaaaaagaacgccagaatcttatccaacgttctcttcattttcactttctcaagtcacatgatgctatcacatacatgtataaataaattgtacctctgcatttaactgaaacaatctctgatcttatttgaaatatcagaatcaacaaagcctttctgtgccatatcatcaagtatcccacacgctttgtcatgtgacaaacccttcttataaggtctgtcttcagtaagtgcctgataaatatcaatgcaagccataatacgctctggtttatttaattcatcagcagtttttccaaaaggatatccttttccatttaacttttcatgatgaagagccgcccagtctcgtatttcctcgaaatcatctatccctgacaaaatataataggtatatactgcatgatgtttcatcgttttaaattcttcatcggttaatttttctggtttttccagaatctcattcccgattgcgacctttcctatgtcatgtaaagctccggcaatatacattttctgacagatatcctcatcaaatcccatgaaccttgatattttttccgcaacacccattgagtggttacttgtaaagggtgatttatagtccacaatatgggcaaaaagatctgcaatagctttaatctgtgcaaaattaagttccagctttattctgggtactttcttccacaacatcgtatccagggtttcattatcaatcatatgaattttttcatctgaaaaagcattaaaaaaaacttccacgcagaaggaatcaaacaatttatcttttgactttattacaaattcttctgttcttttccactcatccgaatctgatttcatagatcggcaaaatatatctatcgtatcacacatatggataatccttgcaaaaaacggtacttcattccattgttttccaaaaggttcacttccatcagcgttttcatggggggggtacagtatgacattagatacatcattatgaaacggtatatttttcagaattttttctcctatggtacaatgccttcccagcttcgtcaccccgttacgtaaagcgtcattttgaagctcttcctgaatatattgtgccactgcattgtcgtgcagcaatgcacactctgccagatcctgcaggctttgaccctgtatacccatttttttcagcagtacaaaccgccatatatgccacacgtttagaatgattgtttgttactttaatcagctctgcctctacacagtccaatgcatatgagcaggctgctaataaccccagcacatcaaatttcatttttgatcttgtctcctcctttgttctgttttctgagaaatctggaatatgcttaccatgacagatttctcagcctcggatcaataaaagcatatgttttgtcttttctttaatttttccatgaccgttggatattttttataatctgtgtgaggtaaggcctgggcagctaccatctgttccagaaaatcatccacttccgcaaattgtatataagtcatttcttccagtatctgatcaatatctgcaagaagttctttgttcagcaaaagcttttgtgctccttccagcgaagaatttccagcattgatcatcttctcccgttccatgtcaggatacatcccaatggtaatggctgattccacagatacatattttccaaaagagccggctacataaaatcgatctgcctgattcagttcaagtccagattcccggagcatgatctcaaccattatatgtgctgcggctttggtaagaataaattcgtcgatatctttctgataaaaatacagacccggagcatattctatgcaaagctgaccttctcgtttctgaataagattcgttttttcaggagaaaacttaccacgaatatctatccagccttctaaaaaaagttccgcaatcagatcgacaataccggaaccgcagatacccttagggctaatttttcctgaagagttaccaattacatgaacatggatttttccacctcttatcctcacgctgtccactgctccggcatctgccctcatcccggtgtgtactacaccgccttccaatgcaggccccgccgcaccggcgccgcaaagaagaaaatctttatttcctatcacaagttcaccgttggttccaatgtcaaagaaaacactgattccatcctttttatataattccgtttcaatcattccactgatgatgtcaccacccagataattagacttcgccggataacaatatacataaccattcagcggaatgtccagatcttttgccggctggaatcccggacggtctgcatgaacagcatgtggcgtataaaagacacagaaagcatctattcccaaaagaaagtggatcatggtggtattgcctgctactaccatagacagacattttcgtgacaccggatgctttacatccagcttatccatgcactctataatagactcaactgtagcaagccgtatttcttccagttttttcctgtcatctttgcagaaaaaaatacgtgataaaatatcggttccccactgaatctgtttattaaagcagctctcttctcccaatatctcaccactattacaatctaaaagtctcaccactaccgttgtacttccaagatccacagccagcccataatgctgtctggctgtatctccgctttctatatcaaccagctcccatttttctccattccaggaaagcgaaacggttattttccaacctgcacgatcaagtaatggatatagttgtctcaacatgcgaaccggaatatgaacctcctctttcacgccctccgcggataaagcttccagaatgcgctgctggtctgaacgctgatcctcttcggttggaacagaaagatcaagatataattttcggctaagacctctcatagtattcatctccctacaatttgtgcattttttattctgtaaaaaaagaaggtcatttgctgtaacatgccttttcatttcatatacagcatttttcacaagatctttctgaattgtatttcttctgttagtcatttgccctccttattaggatttattcttaattagaagtatatatcagaagttttaaaatatcaatataaaattagtaataattactattattgaaatattagcactttgtaaatgtccctttttcgcacaatcttattccataatttttcgttcaaaaacatattctatttcagatgataaatctcttctaaaattgtatccaagtctgtcaaacgtttgtacgtctgcaggattttcaatttctttttctgccatatatctgaccatctcaccacgagccatcttagcatatgtaccttttgttaccagtttatcccctgattgttcacaaaacgtaaccgtaatatatttgtctttatctgataaatatttttctatacatttcgagtattcttttgatgcaagattaatgataatcctgctgtcatcaagcactgaacgatataatcttttaccacaatagtcatatagatttttggtatcttctatttcagctttcgccttcatctccaggcgatgccttctttcatcagcataatcattgtatcaggataaagttcacaaagtatccgcaatacattcccataagttcatgtcattattgaaattgtacatatttcagtatgaaaagttcaccattcaaattctgattattatttctccacatactcttctgccatatgtactgccatagcaccatctgccactgctgttactatctgacgaagtaactttgttctgacatctcctacagcataaacacccggaatactcgtttcagtgttttcacctgccacaatatatcctttattatccagctctatctgattatctaaaaaatctgttgtcggttttcttcctatactcacaaacaggccgtcacattctataatgttttcttctcctgtgactgtatctttcaaccgcacaccagtcaatcgttctccataaatcagttcatttactgtattgttccatcgaaactctatattttcagttttcatcagctggtcatggtagattttcgttgcacgtaatgtatctcttcgatgaacaatgatgactttcttagcaattcgacttaaaagaacagcatctgatacagcagaatttccaccaccaacaaccaccacgatcttatctttataaaacataccatcacaggaggcacaataagcaaccccatgacctatcaattctttttctttagcgagaccaagttctcttggatttgctccagtagcaatcactactgttttcccaatataaattcccgaactagtttctactctcttaagctttcctgttaaatccatattaaaaacttcagcatattcacttttagcgccaaatttttccgcctgtttttgcattttctctgccaatgaaaatccgtcaattccattttcaaaaccaggatagttatcaatctgccaggtcaatgacatctgaccacctgcagataatttttctaaaacaatggtatcaaatcctgctctggctgcgtataatgctgaagtataccctccaggtcctccccccacgataatcatatcgtaaacatgattttcattcatacagcagtcctccttttatttttccaatgcttcattaataaaattctctatcattatttttgattcaggtgcaacaatagaatctattgcctttccatttcgatataaaaccagcgtaggaatcacctcaatcttttcagcttctgcaatctgtggttcttcatcaatatttacttttccagcaacaagaatatcgctgtattcttcacttattttttcataagctgctccaattctacggcaataaccacaccaatgtgcccagaaatcaaccaaaaccggtttttccttatgaattaattgtccaaacttttctttatttatatttatagatgtcatatttttcaactccttctcctatttgaacttaatataccccaaataagtgcttgcttccgtgatgatatcacagaaaagataatttactttattacacttctttttatttctatttatggcatatgccagttatataattgacgcatctaaaaaaagcaagtatactatgttcgtaaaggagataacggttatgaacttcgaaaattgttttccactatggaatgacttaaatacagcacagaaaaaactaatttcagacaatttaatcacacgggatgtaaaaaaaggaacgatcattcacaatggaaacctggactgtactggattattactggttaaatccgggcagcttcgaacttacatactttcagatgaaggacgagagattacactttaccgtctgttcgatatggatatgtgtcttttatccgcctcatgtatcatgcggtctattcaatttgaagtaaccattgaagcagaaaaagatacggatctttggatcatccctgctgaaatctataagggcatcatgaaagaatctgctcctgtcgcaaactataccaatgagttaatggctacccgtttttctgatgtcatgtggctgattgaacagattatgtggaagagtttggataagcgtgttgcttcatttcttttagaagaaacatccattgaaggaacaaatgaactgaaaatcactcacgaaactatcgcaaaccatcttggttcccacagggaagttattactcgaatgcttcgatactttcaaggcgaaggactcgtcagactctctcgcggcaaaataacaatccttgattcgaaaagactggaaacactacaaagatcataaaacgtttttttctctaaagaatcctccatttatcagaattatgaaagtcattctaataaatgggggatctttttatactacaatcaaactataaaaatattttatttatttctaataatccataccacatgcatatgatctttcaatcagtgcatggtcattagccactgcatcataaaagcggaatccacctgaaaagttgtatgtttcatatccatttccttccaaaatacggcttgcaatataactgcgtagcccactctggcatatcaggtaaacaggctttcccttctcaacttcattgatacgttccctcagttcatctacaggaatgtttttaaatccattaatatggcccctgctaaattcacctactgttctcacatccagcaacacagcatttttatctttagaaatcttatccatatcttccaaatgccattgttttaaggttccttttgctatattgtctatcatgaatccggccatatttacaggatcctttgcagaggaatatggcggtgcatatgcgagatccaaatctttcaactgggttgccttcagtcctgcatgaattgctgttgccagcacatcaatacgtttatcaacaccttcatatccaataatctgagcaccaagcaaacgataagtctctttttcaaaaaccaccttcatggtcatcacttttccaccaggatagtaaccggcatgactcataggagaaagaattactgtatctacatctaaccctgactttttggcattggtttcattgatacctgtagtagctgctgtcatatcaaatactttgataacggagcttccctgactgcccaggtaacgactatcaccgccacaaatattatcagcgatgattctgccctgtttattggctggtcctgccaaagaaatcagcgcatcattacccgtaacataatgttttacctgaactgcatcacctgcagcataaatatccggtacagaggtttccattctgtcattcactacaatactttccttgatgccaagttccagaccggcttcttttgccaatactgtgtctggtatgactccgattgccagaactaccatatcagcctgaagggatggattatctttcaacaggacctccactccgttgtctttttctttaaatccttctactgtatagcccagtaccagttttatcccatgctttctcatttcattatggatcatggatgccatatccgggtcaaaagggttcatcagctgcttaggcctctggacaatcgtaacatccatgccaagctccctcaaattttctgccagttccagaccaataaaaccgccacctgccaatacagccgattttgaatgattcttatttatatattcctttatccgaaaagtgtcttctacagtacgaagtgtaaaaagtttatcaatacctactccgggaagtctcggctgtgttggctttgcacctggagagaggatcagcttatcatatttttcttcaaatatctcaccattctctaaatttttcactgaaaccgttttacgttccggatgtatggagataacttcatgatgaattttcatgttaatacggaagcgtttaaaaaaactctctggtgtctgtagtgtaagttcttccgggtctgtgatcacgtctccaatataatatggaagtccacaatttgcataggatatgtatccggatctttcaaacacagtaatttcagcatgttcattcagtctgcgtattcttgctgcggctgtagctcctccggctacacctcctacaattattaccttcatcttatttttccacctttcctgagtaagctgcaatgccaccgatattatttactttagaatatcccattcgttgcagtatcccagttgcctggcggcttcgtgaaccggaataacagtatacaaacagtgggatatccttattcttcgctacagaagcaatattgtcaagttgctgcaacggcacatttttactttctggtatatgtccttcctgatattcctgcggtgtacgtacatccagcagaactgcatcatcagtccttttatattcttctatgccttgattaatattcgactgtttaaagagatcaaaaaatcccattagcacacccccctaaagcatttctaaaatcgcattcttaggtctcgcccctgaaacctgctgtacaatcttcccattcttcataaccactaaagttggaatgctcataatactgaacttatttgccagttcaggctcttcatctacattaatctttccaactttaatatctctacgctcacttgcaatctcctctacaataggtactaccatacggcaaggcgcacaccaagatgcccaaaaatctaaaagaacgggtttatcggaattcagtacttcgttctgaaaattatttttattgatattaatagcagacattttacagtcctccttatctttttctttttgtagatttattatagtcttaatttcatttattttccgtgattacatcaccatacctcattaacttaacttcttgccataccatctacacttaatataacacctgtaatgtaactcgcctcatctgaagcaagaaacacaaacgcattggcaatatcttctggctgtccaagacgacgcaatggaattctttcaatcataggttcgataacttcctttggcacggccttcatcatatcagtttctgtaatcccaggtgcaacagcattaacacgaatacctttaggtcctagttctcttgctaatgatacagtcaatccgtttactgcaaacttcgatgccggataagcaaacccacttggctgtcccgaaatactcaccatggaagaagttgagagaatgacccccttgcctcttgacaccatacattctgctgctacacgagtagtattaaatactccttttacatttagatccatgactttatcaaaagtctcctctgtataatccataaatgaggtgttttctgaaatccctgcattatttaccagtatgtcgacacatccatatttttcagttgcctctttaaaagcctttctgacagactccatgcttgctagatttggactaattccagcaactattgcattgggatatttttcttttaatttatctacagcaacatctgccgattcctgtgaacttgctgccaacacaactgaagcaccttccttcaagaatttatcagctgtagcaaatcctataccacggcttccacccgtaatgattgcaactttatcttttaatctcatttagactacctccttacttagtttctaactacattataagcaaaaggtagattattttctgtgatatcatcacaaaatatcgcaataaaaaaccctgttgctcacgcaccagggttttggtttatccatccgtatttaacacaagattaggcttctattcaacttctgaaaactgatcttttccaacattacataatgggcattcaaaatcttccggaacatcctcccactttgttcctggtgcaataccaccttcaggataaccttcctcttcatcatattcccatccgcaaacgtcacatacatatttcattagtttattcctccttataaatatattaatacacagcatatattactgttgtatttgtgttgttctgtaaccttaatatgtataaatgcttttagcatttccataatccatgcaggttacaatatgcatatacttcttctacctgttcaccattgcaaagacaaaaatctgctaccggctcctgccctggatttaactgttttctgtatattccctggtttgtatttaatgtaatccactcaatgaaatgctcttcaagcattggatgttttgtctctccgaccacgacatgaacatgactgccttctatcgtatatacaggtacatgcttctcgacagcagcatctgtcactccggcttttaattcctgcataggttctccgcaacacattactggtacgccttgatcctttaccatttcaataatgtttccacaatgattgcatacagaatattttacttccatcttttttatcttcctatgtttaaaatttaaaatccaattgtttctataacttttttcaaagcatccaccgattcttaaactttaatgcttctttaccaactgatgcagaaccaacaaagccacagcctatcattactgctttttttaataatcactttcttctttgtaataatctccttctctttaatagttctcttcacgtatttcgaaataactctgtggatggttacatactggacatatctcaggtgcctttgttcctaccacaacatgtccacagttacggcattcccataccttaacttcactcttttcaaacacctgtgcagtttcaatattcttaagaagtgcacgatatctctcttcgtggtgcttctcaatctgtttattgttaataaataatagtaatgattactattattataataatcaatattactgattaccttttatttaaaataatcattcaatcatcattttttccgttcaaaaacatattctgcatctgatgacaaatcagagcggaatgaatagcctagtctatcaaatttcttaatatcctcaggattttcaattctgttttcagccatgaacctaaccatttcaccacgggccatcttagcatatgtaccttttgtcaccagtttatctcctgataactcacaaaatgtaatcgtaatgtatctatcctgtcgtgtcagatatttttctatgcacttagagtattctttcgatgccagattgattataatcctgctgttatcaatcactgagcggtataataaatctccccagtactcatacagattttttgtttctcctattccaaccttcgcctgcatttccaaacgataaggtgtcacaccatcccttggttttagcacaccataaaatgcagatattattcccaaatgattttgtacatactcgaactgactgtcctcaaacacggatggagccatatattgaaaagcaattccttcatatgataagacagctggggtaagtaaatgataaagatccatgttttccaatctattgaagttctgttctgtaattttgtcattacatttccagatagtcttcagttcttcttttgacttacttttcaaccaactttgtatctctgtcgtcttttcaataaattcaggcaatccatccggcgctatgctgtcagtatctgtaatcatctttttagcaggggataatattatcttcattaatctaattccttgagcatattttcaggatcatctgcagccttgactttatcatttgcctttataataatcccctgttcatcaataagatatgtggttcttactactcccatagagactttgccataatttttcttttctttccatacatcatatgcttcaataactttccgctctggatctgctaaaagtgtaaatgtcaatccatatttttcttcaaatctcttatgagaggatacagaatccttactgactccaagaataactgctcctttttcggtaaactgagggtatcgctcagaaaaaccacatgcctgtttcgtgcatcccgctgtattatccttgggatagaaatataaaatcactttttttcctgtataatccgataatctatgtattttcccattttgatctggcaactcaaaatccggtgccttaacccctacttccaacattatttatctctccctttctgtatctttctctttattcgcctttttcttcctattcccggtaatcattttatgacctgtatatatcgccattaccatacataacatagaacttaaagcaaagtatttgtgacttgatttttgctttttatatccagtgtaaaaagtcccaagcatcgtgatcaatgctcctactgaccaatatttatgtgctttcatgtaattcctccattttttcagtgtattcaattctaattatacgctaccatattcctatgtcaatttgataatagagcattcctataaattttttcaaaatatcattgtcaaaactatgtattgttatcctttaatttttctttgaaataattgacaaaaagcttgctttcaggagattactatttaatctcttttccatctatatatagttgaaatttatcaggattattgacaacatcatagtcctttccgtattctacaggtctatattcggctgtcattaccaattccccgtcttcaatatcctctttccttaaatagatgttcatatcaatgctcgtcgcatatcctctgtctgtggagaattttgtcgaatgaaaagagactttacaacttaaaattgaataaaaaggacaaaaaagaagagctgcttgctcttcccatatagtagtagtaaaataatatgtcatgccagcgcaatatattacctagaatatcgctataacaggaaaggggctgcattgtgacagcccctagtttacttcatcacgttgtctacattctgaatgaactcgttccctggtttattttagcatcggtctggattttgtttcataaagataaattttgccacagagcggtcgtatgttttaatgtgtccaaacagccagtcgattacatttttctgtacaagttcactgaaccgatctgtcggtccttcatactcctgaaggtattcatacagttcctgaattgtctttctaaactcttcatgtttttcataatgtttttcacgctctggataaccggatttttcctgaagcttttcctcttctttgaaatgaaagtcagtatattcatccagataatccagcattttgattgcttttactttgctgtcgccattttgacaggcagttacaaagttctggatacggtcgatcaattctttatgctgggtatcaattgtttcatttcctgttactaaattgtcatcaaaggtaatgtttaaatcgtaagtcataatttgacctccatttcttttatatgttctcttaggctcttttaatctctggcagtttcgtacctgcattttctgcttagtcttctacaggaacgaaaacatcttttcctaatccgcagattgggcatgtccagtcatctggaatatcctcaaatgcagtttctggatcgataccagcgtccggatctcctactgccggatcataaatatatccacatggttcacattcctattttatcatagtcattttcccttttcaatatcgatttatttttgttaccaagttcctagcaatttttctaacactttgtttcttgtatatttgtattatacatgataattatcctcttgtcaataatggtaattattattattattattttgcttagcataaactatatttgaattgcaaatttacatattgtatatatcatgggaatagttgaataaaaaaatgaactctattcattaaagacagagttgaaacctcaaacaaaaaataagcctgccatcatccgcagatttctccacagacaacaataggcttcctactatctcatcaactcattcacgattgtcaacgtgttgcgatgaatttcaccatacttaagatatgcatttataaaaatataaggcatccaagaatatcccagatgccctatcgaaaatgtgttttttatttatatagtcacttctattccacctcgaaaaatcaccctgcagctcttgtccttttcagctacaatctcatccagaaggccaccccaaagctcctctctgaactccacctgctccccatcaaggtcctgcagattcatgatgaagtttgtcaaaataccacgcttgtccttccgctcctgaatcatatcattcagttcgcctaacttctcttttttcttttcgtaaagattcctcaaagtatcttcctttttttgatactcttcctgatcctgcacaatccttgtattttcccggatgacactattgattttttctgtcaaaagctctatttccgcttccagcctttcctgctgcacttctaattcatccgtctggcaggtatcctcgatcagctccttcagattgtcaatgcactcttctttttcttctatcagcagattcagtgccttcataaaaatttcttttagttctgactctgaaaagtgtggagattcgcaaggttccttccccttctggtatttcttattgcaacgataaatgactctccgatatttgtcttgggaatgccacacctttgcaccataccagtttccacagcatccgcatctgaccttatttgcaaaaatatccgctccactgtatcgtcccatcttacttcttctaacaatttcagcctgcacataatcaaatactggcggcgggatgatcggtttgtgatgcccttctacataatactgtggaatctcaccttcgttcttcttccgcttcttctgaagaaaatctgtcgtgtactgcttttgaagaagtgcatcacctttatacttcttatttgtaataatggattttacagtgctggcataccattttctccttccagcggggcttgggattcctcttcgttccatttcctgagcaaccccataaaatgtttttccgctgataaacaaccggaagatcagccggatgattttcgcctcttcttcattgatttcaaaatccttatcatacccgaggaatctactgtaagccaccgctccttttccatcagcaaactgttttctcttgccccaagtggtattctcagaaatgctccggctttcttcctgtgcaaaggaactcatgatggtcaaaagcatctcacccttggcatccagtgtccagatgttctctttttcaaaatatacctctacacctttttccttcaattttcggatggtggaaagggaatctaccgtatttcgtgcaaatcgactgactgactttgtgataatcaaatcgatcttccctgcaagggcatcctctatcatctgcttaaagccatctctctttttggtattggttgcactgattccctcatcagaatacattccaacaaattcccaatcttcccggttctctatgtaggctttataataggccatctgagcttcataactggtagcctgttcatcccgatccgtggatactcgtgcatatccggctacccttcgtttccttatcgccacgactggttccaaattgaatctgtttaaggtagcagggattttcgttattttctttgccatgttgtcgcctccccatttttgaatctgaactcgatgctgtcacttcccacaaccagtttctctatatcccgtacaacggtttgctgatagggattttctaaaaccatttcggcagccttcagaagatcttcttccgttaaggcccgaaccttatcttcctggtaatgacgtttcgaacaataccatacttttttcccttggtagcccttatctctttggcatttttctccgcagctgcaccacaccttattggtaaatgcattctgtcctctcagtccgttgaactgccggatataatgtttaactcccctagaagtcaagaactcaagccgatcactatacactgtgacctgtttcacttccttcaaaaacttttcttcatcaagttctgaagttccaaaaatctgtgcactggcctttatcagttcctcttcccatattggtcggcagtcacaaaactttgcaccttttctttccctggtattgcaaacccatctctttcttgtagctgatgttcttcggctgactcccattccgcaatatccgcatttcatcctgccggagaacaccgtcagtttcggatttttatttgcctgccgctctgctctctgtgccctgatctgctgtgccttttttaaatcctcaactgataccagtggctcgaacatctcttctacatagaacatcggcaattctcccttgttcttcctacgcacatgattttctgtaaaaaagtttttttgaaggatcatggtccccgtataggaaatattggaaagaatatcctttaccgaagtctgctcgaatggtccgccctgttgcccggttacacctcttgcggcaagatcctttgcgatgccatatgctgactcccctgcaaggtatcttctgtaaatctcctgtacgctcacaccctgttccgggataatgcggaacatctcaactccgtcccaccgatatccgtatggtgctttatgtccattcggaattccctgttcaaatttctttcggatagcccatttgatattctcggagatgctccggctctcttcctgtgcaaaggaagccagcaacgtaagaaggaattctccatcatacgataatgtattgatctgttccctctcgaaataaactgcaactccgaggtctttcaaacgccggatggttcgcagggtatcaaccgtatctctggcaaatcggctgatactctttacaagcaccagatcaatctttccctgctcgcagtctgcaatcagtctgtggaactcctctcggttccgggtactcgttccgctgataccaagatctgcataaataccagaaaatttccattcaggatttctctgtatcaagtcgttgtagtaactgatctgtgcagaaaaggaacgctgctgttctttctcatctgtagaaacacgggcatatgccgctactctcagttttggcttcagttcaacctttttgggcttaatttttataattttcggcataaagccatctcctttcgcagtgacatattcgcgtactatccgcactatagcaagtccatttcggcccataatgtgccgattataggcgcgtatttctgccgcatttttgtgtcatatttctgatactgttcttcggtaataagccccttttccaacatccgacgtgctgcactcatggtcatctgatacacgacttcttttcttccctgttcccttgtcatacctcatcacctccgaatctggctttgatgtagcatgcgtgggaacagtacttccgatttgcatttccatacacggaaaactgtttcttacataccgggcagacaaagctataattggctttccgttttacctgatccagatgactgttccaccatttcatacggcatttatcggagcagaacttcttcggcttccttcccggtatcagctccatcacacttttgcagcacggacaatactgccttttcccctcagatgatgccagattggttgccactcctccaaggccatgcctccggcaatatgtcttgatggtgttttcactaatttcaagtatttgtgcgattctgccataaccatagccttcttctctgagttccctgatctgctgtctctgtctatcgtccatgtcctttacctccatcaaatctgaagggaacacttctgtatctctatcgttatagcttttcccttcactatcccatggacacgaaatcgttaaatgggcggtaagaaatttataaaatgtgcatcccccttccttttctcctgttttcgagcaaaaaaataggctctgcactacgacgtaccgtaatacaaagcctatttctttgattcttatttaattatcctcaaccatctcatcatcgacatacagatggaactgctctgtggcattcacaatatcatattctgcattccattcttccggtttgtattctacagtcatgatgggatctttttcccctatatcttcctttctggtataaacattcatatccagactggtaggatatccttcatcctcagaaaacttcatggattcaaatgaattttctttatacatctgaagcaaaagcctcgcaaatgcctctttatcctcaatcttatcctgatttgctacaacggtaagcatttcatcccggttcattttcatactgcctacaacatccgggactgctgcctctgccttaccacaagccgagcataccatgattgtcccaataatggtcataaccaccgcctgtttcctattatacttcttcacacgtttcctcctccatacacaacatctcaccaacaagatactggatcagttcttctggtgatggtttttcaccctcatagggtaccctcttccaatttttttgcacctcttcatccgaatccttcatccccacatcaatcactttctggatttctgaatagacctccaaagctgtggttccatgtttcttagcaactttctccattagttctttaaattccatttttctccacctgtagatttaattcttgttctatagaacaatatagcataatcaaacaggtattgaaacaaaaatcgttcgacatagttctacaagaatttacgaaagtacaaaaaaagaagggcttctcagccctccattacttgctattcctgcacatacgcttctattgcacgtatgactcttttttgctctttcggcggcagtttcatgatgcttgctgacagattgtttaccacaccatttacagactgtgccacaacgtccctcaaaagactatccgctgaaacatccagtgcatttgcgattgctacaaacgtatccagttttggtactttctgaccacgctcgatcacactgatatgtgtcggactcaaatctaccaatgcagccagctcttcctgtgtgagtcctttggtctctctggtttccttgatacgcagaccaacatctctcaagtccattgcaacacctccttcagaactatttataggtctaaagatattatatcggttacccatttcggtatacagaatctgcaaaactatttcttgttctaaagaactatatttgctgtaaaaaaacaaaaaaaaggctctgtactacgatgtaaaccgtaatacagagccatctttcttaatatttcgttgcaaaatccaaagagatccacccgttccgcttttccgtataagacttcaagagtccccatttcgttgctccagggccgtctgcctcatccacgatggtaaagaccccaatccctgtgaattttcccttcgcataattcgtaccaggacccttacgaatatagaggtccttaatctttacctgcacagtatacggtgtaaactgctgttttgctgcatacaccaccactccatttccatcaaatacagaatagcccggatgctcatccgcacatttcttcgcattagccagaatcttataggctccaagctggctctttgcatccgcccaggtcttgcggacacggtaatataccgtactggtctcctcttttgtattcgaatctgcgttatacttggtcagctcccacttttcaatgatttcacacaaccgctgcacataggtgctggaagttgcatatccaccatccttgatgatctgcgctgccttcttataattcgtacagcccttcagaccatgataccgaagcgtggagccgttctttgctccaagcaaatatgcggaatgatccgcaatggagtcctcgattgatggatactttcggaaatctgctgtgatggtgatcatctttccgttttcttcttcctgcgttttcttggtatagatgctctttccatcccaggaagaatttccccaggtattgccggacagggatttcttcataccaaaacagttgttggctccctgtgccagctcactctttccatagccggattccaaaatgaactgtgcaagggatacacaggccagctaatgtcattaacttaagaaaatttataaaataaaacagaaaaaggtcttgacaaatgtcagaaaaaatgtggcgaagcctccttgaatgaatacattttaggaggaattgctaatgaacttttacgctgattatgtccgcaacaaactcaacgctgccatttccagcatgtccagtcagatagaagattacgtcaaaaatcccgggcatgattttaccagaaatcggaagatgaactttacctcgacaataaactttctacttactatggaaggtggttcacttaactcagaattacataaatattttaattatgatctgaatcaaataacccgttctggtttcataaagcaaaggaacaaattgaaaccagataccatggaacatttatttcacaaatttcatgagcagatattatgtaacaaaaaataccaaggctatcagttacttgcctgtgatggttctgacttgaatatatttcgtgatccactaaatccacacacgtattttgctggtaaagaaggaacttttggttttaatcaactgcatcttaatgccttgtatgacctccaaagcaggcgatatgtcgatgctctgattcaggagccttatgaagaaaatgaatcctctgccatgattgaaatggttaaaaaactgactacaaatcagaagactatcattatggcagatcgtggatacgaaacttataacatttttgcaaatgttcaggaacgtggtctcttttatctgatccggattaaagatacctcgaaaaaaggcagcatttccggaagcctttccttgccggtatcctgtgaatttgacgaagaaatcgaactgattatgacccgtaaacaaaagtcttataaaacgaaaggttataaatatctctcaaattcatcgccatttgactttcttgattctgagaatttgttttatacacttcatctcagactcacacagtttcagctggaaaatggagtttatgaatgtatagccagcaacctggataaagaagaattcccacctgaaaagatcaaggaactttatcatatgcgatggggaatcgaaacttctttccgtgagctgaaatatacgattggcctgacaaatcttcactctaaaaatgtggaatatatctgtcaggaaatttacgcaaaactgatccagtataatttttgtgaaattatttcagcaaatatcatactggaagaaagaaaccgtaagtacacataccaattaaactacacaatggcaattcaaatatacaggcattatctgcgccagacattcgtaacgatagatgttgaaggtctgattaagaaagaactatcgccccaaagaccacaccgacaatatcagcgtcgagtaataaagaaacgatgggttagtttcgcataccgtataggataaaaaattattcaaatgaatatagctggcaaaaagcagacttttggtttgtttatttgttatgcgtaaatcttgtgatttttcaagaaagctaatctgaacacttattacaataatcgaaattttcttaagttagtgacattaccgtttcagggcccccttgcaatgaacatttatcgcatttcttggttttgcatatcccaaagcaaatgctacatcaattccagaaaataaaagtctgcctccatcttcaatcatacggatggaaccaaactccgaattgtgaaactctgtgattttataatccgtcttctccatcctcttctcctcctgcaccggcaagtaacatcaaaccattttcaatgattgtgctccgaataaactctgctacattcacggttaaataaccaagatattctgcaaggaaacctctatattcctcttctgtcagtaattcctccagtgcttccaaatgagctgtcactttagaagtctgttttccgccaagcagcctgcctaatatttctgtaaattcctctgtgtcacatgactcaaacatacataagatcatctccattgttgtttccaaaactaaacgatccattttcatttttgtcagctcttccattgttttcatggaagtcataagcgcatcacttatcatatgttctgaattgattcttccttctgaatcaactaatcctattgcaaataattctaaaaagtattttctcataaatcttgtcctcctatcgaaatggcatttcttgttcaagttcttctggtatatcgaatggaatcttcctcttctctgctggttgaaatccatcagattcttctttttttgttttggcttctgcaaattccacatcatccataatgacttcggtataataggatgcagttccagtctgttcatctttgatctgagagattactaactctccggaaagagcaatcttaattccattttcaagatatttctccacaaattctgcattatttccataagctgtgatcatcactacaaatgctttggttgtgcgatttctttttactactagtggaaacctggatactttggtttgtcccttttgcgtagatgccagcttagtttctggatctctggcaagcctacccattaaaacaatcgtattcatgcttcttgtccttcctttcctcctgcaacacctttccctggtatttcaaacaggataataatctatgcattttctgcacgaaaaaatgaggaatggagtcgaaccattccccacttgctacaggatttctcctgtaatataaataagaaaatctaagtattcgcatttgggctttgtctgtacatatacatctgatcgttatcattccagataacccggctgcaaaaatacagtcacagtctctgttttagcagaggtcctgtacctttcggtggtatcattattgcttcgctcttcccgtaggagtcttcgcctgcacgagccggattatctccggtaagcatgttcctcaagatgtatcagctccttcaattgtcaaggtgcaatcggaagaactgtctgaacctcttttatgtttgtgatttttggaaatcagaggattttcaatttgccttccatatactctgtattgggagcgacaaaatcggacatgattttagaaagtttttgaaattatttttttgaagtgtaaaaagacataaaaaaagatgccaggatttctcctgacaccatagttactgtgccaacttcgtgcccagtgggcacaaggttggtaatcaactattattgccatctatatttcaaataaaaaaacaccctcattccggtcattaatccaatccgaaaatgggtgttttctcatacctcaactctatgactatattctatcaatttttaagtacctctaatatttttcgatctataatttgaggtgtccggatttctcccgacacctcaacaactaacactacattttcaatcagactactttttattctttggctttattccccagaataccacattcataagtattacgatcaacagcacagcagccatagatacccagaatcccatattgagtccgagccattcacaggttccaaaaagtgtcatccataattctttccaattcattctttccacctcctagagcagttcgccataatagcggacatatgcttttttcaagcttgttgccagcatcatatacagcagaatacatgggatcagatatgcaaagtatgatgccggtaatgctatcagaccaagtgcagttccaaatggtgtgaacggaatcacagtcagaactgcaatacctgtcatggtaagcaatgttaccggtgctgatgcacggctctggataaacggaagctttggtgtgcgaatcatgtgaatgactaatgtctggctccacatagattctacaaaccatccagcctggaacattccgatataacgtgcctgcatagcagcaagctctgcaccgctgtaatgggctgccaaatcattgaacaggatgccctttgacacaaataacggacagaatacaaagtacatgaaaatataagttgtaaaatcaaaaatcgaacttgtaggtccaatccagatcataaagctacccacactggatgcatcccatttacgtggtattgcaataaattcctcatctacattgtcccaaggaatcgctgtacaggacagatcatagatcagattcaggaaaatcagatgtacactcatcattggaaggaaaggtaaaagtgcagaagcagctaatacagaaaacatatttccgaagttagaggaagctgtcatcttgatatatttgatcatattggcataagttttgcgtccttctatgattccctcttccagaaccatcagatctttttccagcaaaatgatatctgcggattcttttgccacatctaccgcagtatctacagaaattccgatatcggcagccttcatagccgcagcatcattgattccatcacccataaatcctacggtatgaccgttttccctgagaacggaaaccacgcgagctttctgatccggtgtaagctttgcaaatacctctgttgtctctactgcttttgcaagctggtcatctgtcatatgatccagatcagagcccagaagcatgttgcttacttcaagtcctacctgtttgcagattgtacgtgtcaccttatcattatcacctgtcaaaatctttgtcgttacgccgtgtactttcaatgcccggattgcatctgcagtagactcctttggtggatcaaggaatgccagatatccgattagtaccatctcacactcatcttttataccaaatgcacccactggagaaggattgcttttttgtgctatggcaagcacacggaatcctttgtcgttcagctcgtctaccgttttcagaatacgcatgcgaacttcttcagtaagtggcttcacagtgccatcacactccgcaaaagaacagatggatagcatttcttctacagctccttttgtcaccatctgtgtctttcccttcttatcctgtactaccgtagtcagacgacgacgtgtaaaatcaaatgggatctcatctaccttcacatagttttctgacagatcgaggagctttggatctgccgcctcttcttcctctgttctgtgaatgatcgccagatccatcaggttcttataacctgtctggaagtagctgtttaaatatgcatggcgcagtactcttgtatcatcttctccattcacattcaggtgatattccagcacaaccttatcctgtgtcaatgttcctgttttatctgtacaaagaatatcaatggcaccgaaattctggatggaattcagattcttaacaatcgtctgctttttgctcatggaaacggcaccttttgcaaggcaggttgttacgatcatcggcagcatctccggagtcagtccgacagctatggaaataccgaacagaaaggcatccagccagtctccctttgtgataccattgataaaaaataccagcggaaccatgaccagcataaaccggatcagaacccatgacactgcattcacgcctttggtaaagcttgtctccactgcttcacctgcaattgcagatgccatggaaccaaataaagtgcggtctcccgtgcagataaccactgctgttgcacttccggaaattacattgcttcccataaaagcaatattgctgtaatcggtgatgctttctttctgtgcacataccttcggtgtcttttctaccggttcactttcacctgttaagcttgcctgactgataaataagtctttggcatccagaatacggacatctgctgggatcatgtctcctgctgaaagatgtacgatatctcctaccactagatcgtccataggaatctcaattttttcctgttctcttcttgtaacggtacaagtagttgtgatcatggataacagtttttctgctgcatttccacttctggattcctgcacaaaacgaagcgtaccggagatcataaccatggtcagaatgatcaccactgttaatggatcaaaatcttccggtgaacttcctaacagagaaaaatatggaaaaaccatatctgtcatagtagaaacaactgccagacagaaaaggatcgctgtaaatggattgataaatgctcctgccagacgtttcacaagggattgtttcttctcatgtgttactttatttgatccatattttgtccggcttaccgctacattttcagcatccagtccacgaagtgttgtgtgcagactcttcaaaacctccttaatcggattggtggccgcatgttcgatgcgatggttctgctcgtcacggatcacagcctgctgtgctgcctgacgaacagccatacgattttctttcttattcattggtctttacctccttgttttgcaattattttttatagtatcgatcacttttctcgatataccaaagatcaaatcctgccacaataaaccatgcgatcatagcagtcacaaaccagtgattttcaaagcctgaccatagacctttcagcaaaaaaatcaaaccatttaatgcaatgacttcaccgatgttacggcaaagcggcacaattttgatcttttctttctcttcctgcggcatatttttccaggaagataaatgaatatgaccttttccacatgcaaacataaaaccgacaatcgtgaaaatgatgccaaaaaagatacaggttaaattcatggttttcttctcctttcattgattcatctcattctgagcttatttattttctgaagcctgataagcaatttcaccattgtaactgccaaaataatccaaacaacaacagatatttgataccagacctctatcaccaaaatttggtgagccgaaaatataaggctcacacaactgcatgctgcagtgaacaaaatataaagaaagaaaaaaattatccatctatcacatttgttttttttcaactacaacacctcccaacctgcactgattacttccggaagttccaatgcctgaccaacaatactttccagaacattacttttcggttttcctgcagaacaatacttcgctataatctcgactttatcccccactacatctccactttccagatgattcagatacaaagtcttactggaattactgttaatcagtaaaagtcttatatcctgttctgcaatttcctgacaaagtactgtgatgcagtattctttttcagattcatctccaacagcaatcggattcagctttcttgcaagcggacgcaggatcagatttgaaccaatcaaaatgcctgcagcggagactgccattgtaaacattcctgtgctggcaagaatgccaattgccgctgtacaccaaagtgttgctgctgtgttcattcctcttaccgtaccgctgtctttaaagatcacaccgctgcataggaatccaacaccggagataatgctgcttcctacacgaaacacctgatcggaaccataaagcattggaaataaagtaaaaaaacttgttcccatacagattagaacattaatccgtattcctgctggatgccctgttaactgcctttccagtccaataaaaaatccaagcaacacggataaggaaattcttaatacaaaatctgtgtataccatacataccgcctcccttcgactcctaaagaatacaaaaaaagcaaggagaatcacatgaccaaagtcttgcgatttccttgcgatttagcaagaattataaaaaatttggcggacttaaatcagcccgccagttttacaccttatcattaaatttatatccgatcccccaaatcgtaagtatatactttggttcatccggattcggttcgatcttctttcgcaattttcgaataaatgccataatattactgtcgtctaaaagatagttttcagaccataccgccttataaatctgctcctttgtaaatacttctcctctgttttcagccaggaaatacaggatatcaaactccttaggagtcagggaaaccgcttggtccatccttgtaacgctcctgcttttcggattgattactaattccccaattttcatttcatctgaaagattgagagatgcaatttctgaattctttacagtgctgagcagcaatgaatttacctctccactcaccatatcataaataccggaaagcagttctttcgcactgtcactatctggtggttctttgatcagcttttgaatgagccattcctgcaggacagaatccatggaaataacactgatattctttttcacgatgattctcctcctttcagatcagctcatgatatttcttctggtaaacaattttgactactgtagtcagaaacatatagagtaggactacgacaaataaaaacaggaaatacctgattggcaatttcgtcaatccaataacacctgcgcctttggtaaaagtaagtgcagtaaaggcaataattcctgcaaaggtcgtacaaacaaccggaatggaaggactgctctgtacaaatggtatcttccttgtccgaaggaaatgaaggatcaatacctgcgtccacatcgattctaaaaaccatcctgtctgaaataaagcaacatactgtgactgcatcactgaatctactatattcagatacgttgctccaccacacaacaccggacataaaatataatacaaaaataaaaatgtcacaatatcaaataatgaactgataggaccaaaaaacaacataaaccttcccagtgtctttccggaccagtctcttggagatagtgtttcttcctcatccacattatcccatggaaggataatacataaaatatcatataacagatttaataataatatctgcaaagatgtcattggcaaaaatggtaagaatgcactggcacaaacgatagaaaatatattgccaaaattggagcttgccgtgatcttaatgtatttgagcatattcgtaaatgtcttacgcccctctaaaattccctgctccaatacgcccagatccttttgaagtaacaccacatccgcagcatctttcgcagcatctaccgcagtatctactgaaataccaacattcgattcacaaagagccggaatatcattgattccatctccaaggaaacctaccgtatgtccattttgccttaatgcagatacaatccttactttctgtccgggtgtgagttcagcgaaaacatgaatattttctactgctttgccaagttcatcgtccgtcatctgatctaactcgacaccagtcaatatgatttcagaagagattccaactctccggcatatagaagccgctacgtcagcctgatcacctgttaatattttcggtgtcacctttagtttttttaaagtctccacagatgtcttagctgtttttttcggagcatcaaagaatgcaagatatcccatcaggatcatattattttcgtctgtcggtatgatctggtcctgtttctcaatctttttccgtgcaacagcaattactttcattccatcctgcagcatctcatccactacagaagctacgcttaaaattctgtccttttccatcggaaggatttcgccacgaaattccacatgactacaccgggacataatctggaaaatattacccttcataataagctggcaatctccatttttatctgtcaccagcgtactaacaaatttgcgggtataatcaaatgggatttcatcctctttctgatactgcgtgagaagaccagcaaaatgctgctcatgcccaggcatcgtctgacatgcaaggattgcgttatcaatcggattacatacaccagaatgataagcactatttaaaaaagcaaaatccaatacctgcccactttcgtttcccagcacatccatatagtattccaataggatactttcattggtcagtgttcctgttttatccatgcagagcacatccatgctgccaaacccttgcattgcattaatgtctttaatgattgtctgctttttactcatactcagactgccccttgcaaggcaggctgtgattaccatcggcagcatttccggcattaagccaacggcaacagacagagcaaacgcaaaggattccagccacctaccaccggtaatcttcaaaagtataaatacaataggaattaataccgcaataaaacgaagcatgacccaggcaattgagttggctcctttttgaaaagactgtttttcatctggttcttctttcgtaaaactgccatatagtgtgtcttttccgactgcaagcacaataccctcaccttttccactgatgaccgtcgttgccataaatgcaaggttttcaagccgagtcaaggattccgaattactgtaactcagtgcctgtgcatttttttccaggattgcactttcgcccgtgattgctgcctgggaaagaaatagatcacttactttggtgagtctcagatccgcaggaatgcgatcacctgccgcaagcagaacaatatctccaaccaccagttcctcagctggaatctctttcacttctcccgcacgccgtacggtaatgctttcatgtatcagctggtttagctgttttgatgcattctttgcacgaagttcctgaaccagacggattgttccgctaatcaaaatcattgaaaatatgataaccgcagtcgttgcatttctggcaaaattcgatacaagaaccacgtctgtagccagtgaaatgattccaataactaaaagaatgatattaaatggattgataaatgcacgccgcaggagtcgtaacatggtgtcatttcttctttgcgagaaactatttataccatacttcgccctcatcaattcaacctgtgattgtgacaggccttcccctgatatctctaattcctgatatatttgtgatacttctcgataagcatatttcttaatacaacaatcgatcagtgtagttttaggcatataggcttgcctcctttctcaataccgatatatttattttaacattatcttaaaaaaactccatgcttagattcttgcttttttcttgcgattacattgataatcaacttctacaccgcacctctttaaaaatcaataaagccggtactggatatcaaaatcctgcaccggctttatcgatttaattattctttagactcaaccgattggcatgcttgcaaacttgaagttaaatctttgttttaataccatgttatattgtcaatttctttcagtaaattttcccaatttcttttttcgttccatttaatttttccttcttcaatggaacctagctctatatcaaaacatttttcattgtcattaaagaatttccagttcaacccattggtatatataacttttccaaacgacttaatatgcccaagtaattgttcatcgttatcacctaaagctattgttggcatttttgcttctatacatccatatataacagcatcttgatctttttttctttcaagcaatacaaaatctggaaaacctgaaaggccataaaattttgctgaaatttcacttctttttcttgatgacacatctcgtatagataatttttgcttatttttagattctctaattacacttgcaattattgaatagagttcaatttccacacaagcattttgagcaaaagctaactcaatttcttctttaaaatcatcaaaatctcttgctattgacattatatcaccatcccatcaaatcccgaatttacgacaatatttctaatacagattttaccgtattttttagattcagtccatcttttaatcccagtcggtagaaaaactcttctgtatctgctccactactgaaaattgcgttacagtattccgtaatcacttcttcctgttctggggataacgtttccagtaattcctggtatttcttatctatctcacttaccggctctttatcctgatttaacttccattccgaatatgctttccccatatgctctgtaattgtcagattcacaaattcctgcacttcctctggtatggtactcgtagattcctgtttatctttctttttatcatttgatttttcaagtgtcgtgtcatcaatataacgaatgatttctcgaatatttgacttcatcgactgcagatatcctttcatcagcacagcaacttttctagcatccgatttttcgttttctttttccagcatataaaactcttccagttctttcaggatatccatccctgctttcatctgaaattccacctcaagcaaatcatccatcactttatataattcttccattgtttatttctgcctttccatatagtatcactatattttccacaatcatccaaaaataaagtcctgtaatccacattttacaacttcaatcactgcaacgatccccataccaatatgtggaaagagtacaaacactactgtcgtaatgatcgctgatttcattgtccagtccgtgctgattccaaatccaatactcaagacttctgtcacaacagagattccggctatcagatagcagaatcctgcagataatccaaccaggaataccaacacaatatttaccgctgcaagtaccagccaaacaggagctgcaataattcgaaatggcagttttatcataaatctcaacataattcttcctcctactttgtgcccagtgggcacaaggttattttaccatatctaccggatatgactatctctttttaaacttcgtgcccagtgggcacaaagttcttacccgtccggaatatccttgccccagtacatatcatgtcgaacttcagcatcataaaactgattgatcgttgctggggcattatacaacaccgtcaacatatactgccggatattcttcactttgcttgtactcctgtcaagactgaaaaacacatactggatgtgttcatacccgactttgagcaaacggctcttgaccacttgtgtaggcacagcttccccattgatctgttgatatggctttgtcgaacatattgcatccagcatcagctctaccagctcttctacttgtccagttccatagctctgacaaagaatctcatattcgatattgtcatgaattaactgtcgatactcatttctctcctgtatcctatctttccctttctcttgttcagatagatattgataagattcattctcactaaattcagtataattatattcagtattattacagtttgtttttgaaacttcttgaagtttgttttctaaacttcttgaagtttgtttttcaaactccttgaagtttgtttttgaaacttcttgaagtttatttttcaaacttcctgaagtttgtttttcaaacttctgtgtatttacgggcttttccggctctttttccgcatattcttctatttctgtctctgtattttcttttctctctgctacattttctagtgttttttctgaatcaaagattgctggctcatctggatattctgtcaggctaaaatttttcacgtaaataacatttgtttttccaagtccgatccgtctcttctcaatcaatccaatccctttttcctgatccagctctttcagacaattcaccgccttattcctgccacagttaagcatttccataatctcttccaccgaaaagaaaatatatgccctgtcctcttcgtcaaaccaccggttcttgatggacagtgacatccggtctaacatcagtccgtacagcacctttgcttcacaggagagatttttaaaatattcacttgtaaacagcagtttgggaatacgataaaaactgtacatatcgcattccattccttgaaaatagtggaatgttgctcttatactcatgacccatccctcccttcgtacttatcaatgattctgattgctccattcctccaaaagctgacatataacagtccgtatcttctgttcatcatactctggaggaaaatacttcttaatttcatcctgttttaatgttaccgttgttttctttttacgctctcctataaccaggagccgcacaatctcttttgtcagcgttttttcttctcgatgttgccttatttttttcgcctgttccagacttggatatttcccggtactctcatgcacttcctccaccatctcctgttctggaaccgcaagataggaaagctctacacctacctgcaatccaatcacatcacggtctactgcgtttaataggtcattcatcagatacgtgagccgaatatagcgatacacctgccttgcactgtcatttccgttctttccaatatctttcgcactgatacctcctgatgttccctgatgattcattgcttccatcttcatacggtatgcaaatgccttttcacttgggagtatattaggtctctgcagattgctgtctaccattgcccgaacagctgtatcctgatccatatttctgataataaccggaacctctttaagaccggcaagttgtgccgcatgtctccttctgtgaccggcgatgatttcatattcaccatcacccagcggtctgaccagtaatgctgtaagaattccctcttctttcacactttccaccagttccgccattgcctcatcatcatttacttgaaacggatggttctcgaaagaatgtaaatgctcaagtgaaacctgctggatatcgttcgtttcttctcctccgccaagtaattcatcataagatgtcagttttatcttcgatgcacttctacctttcatccaaaagcacctcctgtgtcatctgccaatatgcagccgctacttttccttttggatcatgctcaaatatgctgattccttccgcactgatctcagctgctcgtactgaaaatggaatactccgtggaaaaatcttgatctggtttccatatgtatcaaaaatcagatcagatatatctcttgcatagttcgttctattatccaccattgtgatcaatataccgccgattttcagttgtttgttaagctgtcttcgcacctttcctatcgtccgtatcagctgttccagaccctttacaggaagataagccgcctggacaggtataataaccgcatcgacactggcaagtgcattgatcgtcagcattccaagtgatggcatacagtcaatcaatatatagttgtattcttctctcattctttctatatattgttttaagacaagttccctactcataatatttacaagtgaaacttccattccagagagttcgatgtttgccggaatcaaatcaattccttcctggtgatgtaaaattcccagtgtattttcaaatggttcatcttctacaatctttgtcagaatagtagccagtgtgattggtaattcatctgggttatgatacccaagacttgctgtcatacttccctgcggatcattgtcaatcacaagcactttcttccctgcttttgcaagtccgactgccagattcacgcaacttgttgtcttgccaaccccgcctttttgtgaacacaatgccagcactttacaatccttcattactttctcttccatcctttttatcctcccataaataacttgaacctttcagcatccataatgctgcttccaaaaatgcaagataccgttctgtcatactatcaagagccggttctgaaataactggtttttcagacttcaaatcttttgccacatcctccaaaaccaaactcatttccttcatttctgaccggataatttcaattgtttctttctttccaacaacacatacatgattgtaaatgcatgatcggacgatataatcctgttttttcattccgctcactttcactcgttcttcaatcgttgctttttcataagaattcacccgaaaagaaatggtcgttgtgttgtgttttccatgtctgtcaccagccatcgcttattcctcctcttcctcatgtttcttatccagcaaacctgctaatttactctgcgtagacggatacagatgcgaatatgtattcaacgttgtttccaccttttcatgtccaaggcgttctgcaatctccaatggagccacccccatatcaaccagcatactggcatgggaatggcgaagatcatgaagtcgtatccgctttacaccagaccgctcaattccggtagccatacaatgttccatatgcgatttggtaaaccgaaaaagtctttcctttttcataattccatacaaatgactgcaatactcccggaattcctctgcaagaaagtccggcattgtaatcacacggatactctttggagttttcggctgcgtgatcatatcctttcctttcaatctctgataagatttattgattgatatggtcttctcttcaagattgatgtcattataagtaagggcaagcaattcaccgatacgcattccggtccagtacagcagaagaaatgccattcttgtttctggcttatcacttactgtctccagaaacgcattgaactcttcctgcatccagaaatccttcggttctcctttgctcttgccgatcgctcctgccttcctgcagggattatcttgcaggttataataccgcatggcataattgaaaattgcagtcagctggcagttcactgttttcagataagtaggagaatatccttttccattcttatctttatacgtcagcaactcattctgccatgcacggacgtctgccaccgtaatttcactgagaatcttcttttcaaaataaggcttgattttcaggtcaataatataccgcttcgtatacatagtgttttctctgagacggacatccatatctttgtaataaatctccaaaaaatttccaaattcaatatccacaccctggctctgctgttgtaggaaatctctttcccattccctagcttcacctttggtcctgaatcctcttttctgttttcttttccgatttccctgccagtctttgtaatagacctgtactttccagttttttccttctttgtaaacccccattactaatcctcgactttcatgccataaatcttttctgccaggaatttcgtagagatttttccagctactacaatatatccttttgccttcaattctttgttgtattctcgcatcagactatatgcataagtctttgaaactccaagaattgcacacacatcatccacatccatatacattttttcctgcaccatactcataccgctttatcctccttcaaatactgctcaacatgttccagaccatagatcttgtcctctacataacgggttggtacccgaccgagaatcacataaaagttcttgcttgccagatcggcattcattctttccaccacccggtaagcaaacgaaactgataatccaaagagttctgcaatgtcttccactgataaatacatttttctcttacgcatgaaaccattcctttccctcttcctgtggaatctcacaagtatcttccactccgtagaagcgcttcacaaaatactttgtcggaacttttcctctaagcgtcagatatccctgttcttccagttccttgttcagatttccgatgatctcataagccgatgtttgttttacttccagaagttcacatatatcggctgcctttaaaaataatttgttctgcataatcagtacctcctgtgttttgaatatttatctcttcatatactctgtactggcagatgcaaaatcggacatcatttttcgaaatttatcaaattttcttgttttttaattctccatcagtgtgattactgtgtcatggagtttaagctcatcgaaagtaaagaacctttctgtggtatctgttttctaaatgcaggcaacaaaaaaacagtctgccttgacgaaaatcacttcaatcaaaacaaactgttcttcatatttactctaattttattttatgagaataactgatttcacgaaatttgcaggtgaatctggaatataaacaagagaaaaaaataatttttaaactccatttgcactccatttggtcttttcgacaccccgcaaagcctttatttatgggcttttccgcgatttttcaagctactcaaattcaatcgttgctggtggttttccagtgcagtcatacatgacacgattgatgtgttttacttcatttacaattctgcttgttgtttttccgattacatcccacggaatttctgcgctttctgctgtcatgaaatcagtcgttgttaccgcacgcagtgcaattgcgtaatcataagttctttcatcacccataacacctacagaacgcatattggtaagcgctgcaaaatactgtccgatttctttatctaacccggcatttgcgatttcttcacgccagattgcatctgcatcctgtaccattttcactttctcagcggtaacttcaccgataatacgaattccaagacccggacctgggaatggctggcggaatacaagatattccggaataccaagttccagacctgctttacgaacttcatctttgaataagtcacgaagtggttcaataatttccttgaaatctacatattccggaagaccacctacattgtgatgagatttaataacagtagattcgccacctacaccactttctactacatccggataaattgttccttgtactaagaaatcaacagttccgattttctttgcttcttcttcaaatacacgaataaattcttcaccgatgattttacgttttttctctggttcttctacaccttttaatttaccatagaaacgttcctgagcattgacacggataaagtttaagttgtaaggtcctgtcggtccaaatacagcttctacttcatctccttcatttttacgaagcagaccatgatctacaaatacacaagttaactgatttccaactgcttttgataacataactgctgctacagaagagtccacaccgccagacagtgcgcaaagtacttttccatcgcctactttttcacggatagctttgatactttcttctacgaaagaatccatcttccagtcaccagaacattcacatacattgtatacaaagttagaaagcattgtctttccttcttttgtatggagtacttccggatggaactgtacggcatacaggttcttctctgtattttgaacagctgctaccggacagtcatcagtatgtgcaataatttcaaatcctggtgcagcttctgcaatatagtcattgtgactcatccagcagattgttttctcggatacattttcaaagagttttgttgactggttaaccgtaacttcgattttaccatattctcttacaggcgctgtctctactttcccgcctaataagtgcatcatcagctgcgcaccatagcagattccgagtacaggaattcccaattcaaaaatttcttttgtataagttggtgaatcctctaaatatacgctgtttggtcctccggtaaaaataattcccttcggctgcatttctttaattttttcgatatctgttttgtaagaaaaaatttcacaatatacgttgcattcacgcacacgtcttgcaattaactggttgtactgaccaccaaaatcaagtacaattacggtttctctcttcaacaaactctcctcctgttcttttttgaatctttttaatcagctttttcatgttttagaagtatgcattttaatttttgcattgtctaagtgctcatattataagccatctaactggattttacaagttctttcaaaaaaacacctttaatttacaatatccctaagcccgctttgcttttacatcggattcacatgcaccatacaatgttttacaagaggaaaatttttctcaactgcatcatgtactctctgcgctatttcatgcgcattttccagagaaagtgttttatctgctgcaatttcgatatccacataaatttttgcaccaaacaatctggtctggagcaaatcaatattttccactccggtctgacttgcaatcacttctctcattttctgaattgtcttttcatcacaagatttatccaccattttatccacggcatctttgaaaatatcgtaggctgctttcccaataaaaatacaaatcacaacacttgcaatcgggtctaaaatcggatatcccattcgagcacctaaaataccgataaatgcaccaacagaagataatgcatcggagcggtgatgccatgcatctgccataagtgctccagaattaattttcctcgcagctcctcttgtgtaccagtacatccattcttttgttgcaattgataccactgctgcaacaagcgcaaccaaaccaggagctttatttccttccactccttttataatctgttctaaaccattgattcctattccaattcctgttgcaaataaaatcactgccaaaataattgctgccacacattccattctgtcatgaccatactgatgatctttgtcagatttttttcttgaaatgttgattccaatcactgccacaactgtactaaatacatctgaagcagaatgcactgcatcagaaatcatagcaccggaatggcccaaaataccagctaataacttcagcaatgataaaacaagatttcctgcaattgtaactccggatactctcatcactatcttttttgatttttcatctgaaagctgttctaactgttctgcatccatttttatatcctccttcttctgtaaagcggacatttgcaatccacttcgctacttactcataaacgcagtcacttcgcaacctgtcacagtgggattagtgcagagtattttttgtttcataggatgctcctatgaaataaagaaaaaagcacctgtggaacaataagtaaactactgtcccacagatgcttttcattttcacctgctgtcacttttgtgacccggcacgtaaagatttttctctctttcctgcctgtttcgttttacgtcgccctcggcgtttttaagattttatgttattctatgacacgaaatacctgttagtcaatagaaacattcgttttatgtaacctcaaaaattcaggcatttatgacgcaaagtcagctgcaaaatcgtccccaaactcgaagattgagatagcactcacatcatttttatacaagagaagcatgtttccactttccgcccaggtaacggatagtaaaacagatagaccgaaacagccagtcaatcgtcattgcaacccatattccaaatactccccattttaaatacgagcctaaaatataactgaatccaattctaaacgtccacatggagacaatcgccagtatcatcgtatattttacatcggctgccgcacgcaaagtatttgcaagtgagaaagacaatggccagatagttacaacacagcagctatgataaatcaaaattcttcttgcatattcactggcttccgctgataatccataaacttttataatgaatggaagcagaagcaccaccaaaatattcattaaaatcaaacagatgtacgtcagcttcattaattttttcgtataatattttacctgttcaaaatctcccgctccaacacactgcgccgataccgtgagcattgcaaatccaattgacattccaggcagtaccgcaaacattgcaatattattagataccgcatttgctgcaatcgaagcagttccaaagctcgtcaccaggctgagtaccagaatttttccaagctgaaacatactgttttccagaccgttcgggattccaatatacaaaatctttttcaaaagattccagtctgtatgaaatgaaaatggatgaaagatatgaatctgacgactctgattatttaacagaaccaatataatcgctgccgctacacatcttgatactaaagttggaatagctactccctcaattcctctgtggcatccataaattaaaactgcatttcctccaagattaactgcattcataatcaatgaagtaatcatggcaatggttgaatttcccatggaacgaaaaatagctgcacctgcgttatatactgcaatcattgggattgacgcaaacacaattaaaaggtaaatattacagttatacataacatctgcgtcgattttaccaaaaataccatgcaggattacatttctaccaagatatcccaatgccataaccacaaccgatgctttcaccgtaaataacaacagctgattcgttgccttacatgcctcagcctctttttgttttccaataaactgaccggcaattactgcgccacccgtagctaatgccgtaaaaatattaataattaaaaccattactgtatcaattaacgaaactcccgatacggctgcttctcctacacttgctaccataatagaatctgccagtcctacaaatgcctgcagaaactggtcgataatcaatggtacaatcagttttttcaaatcctcatttgaaaaaaatcgcttcattttttcactcacactccatactattttgtacattttcagatgagtctattatactcttgcgatgagaaaaataaaagagtcggaacgttccagactcttttattctttataaacactgcaaaatcaaccatacattttcaaaatttcgcatctttaaatcctgcttttttatccaaaaataaaggtttccttgatattcccatctgtattcatcatcgtatccatctattgttcccacctgaaataaaagcatccaatccttacctttttcccaaatttcctctctttcctgctccggcacatcctgccagcctctgcctagataatatccccttgtaactccttcacattcttcttccattcgaccctgtaagacatccggattccctaacaattttatccttctgtatgcccattcgtaataatattccattccctcctcaaatatcggaactccacaggattgcagacattcatcatagtcgtctaaatcatcacacacaattccctctgttttttttaatttttctaaatccggaagtagctgttcatataccggcagactttcttcgttttttatccttacaattttcatttctgaaatgattgcatctttctctaattctgccggaaaatccattgcttcaagttcattttcatccggaaaataataaaccttcgcacaacctttatttgctggatcatatccataatccatcgaacgcatttcataaaagaaactaagaattccttgtttcggcaataattcttctttatcataaggtgcaacatcctttaaattaatctgtataataaatgataagggtctttctttcctgatatcttcaaaatctttcccttcataaactggccattcaaaatcttttggaacatccggctttcctccgattttagacgctctttttgcagcaccactttttagagtgtaattgattactatttctgttttcttattttgttttatcaactcacaaatcctatttttttctgcctgattcatcttatttcccccaaccttttatttttatgctcttatcttaccattctttcccttctctgcaaagaactatctttttttcttccaaaacaaaaaaagaaagccagattttctgactttcttaatttttacaatataatcagcagcagctgtcttactctctttctactgcttattcattactgattcattatttattatttcattctatgtttcattctttttccaacaatcactgctccaattcccacacagccacttattccaaacagagcaagccaaaattctattctgctgttatctcccgtctgtgcatttttagcagttgtactcttattcgcattacttgttgctgttttatttgcattatttgttgctgctttatttgctgtcttgtttgagttgtttgctgttgccttatttgtattatccgtcgttgtcttggtagatgaggtctgttttttctctagtgaagcaatggcatcttctattgcttttgccatcttatcgacttcttcctgctcggtgatattttttcctcgaactactgcttttactgctttttctactccagtaaagtctttatagtctgtttttttcagtgaatttgcttttttaactgcttcatctacttttgtataatctgcatctttatattccagagcgctaatggcatcttctattgcttttgccatcttatcgacttcttcctgctctgtaatatttttgcctcgaacaaccgcctgaactgctttttctactccgctaaaatctttataattttcttttttcagcgcatttgccttttcaattgcttcatctgcttttgtataatctgcatctttataagtcaatgtcagtgtctgggtatgcgtagcaatatctgcagtaaccgtaatttcaccgctaaaaggattacaattatccgcagttatttcaaccggatagattcctgcttctaattcagccaaacctgaagacacttcttctccatttactttaagaaccacatttgtcaattctgccggcactacagcaaaggaaacttcatacttaggttttggcagaaccggagtcttttcagaaacataattataatttccgccacctgccacaatttctttataaaatgcttctgttctcatagaatcaaatggtttcgctgtacctgctgctgcattttttccgcacgccaaaacattttctttctctgtataataattattcgtgaaaatacctgtacctgaaactgctccactaatgccaccaaaccggctatatggaacagtcgttaccgtatactgtgacaaatcaatatttccagcgaaataacagtggctgactgtcgtttcatttcccactgttcctacaattcctccaacatccgtaatcccttttccgagcggggttaatgttcctgttgaatagcagtttaaaatcttagaagttccactagtctgtccgacaattccaccaccatgacttgctgccagtatcatatttccagtatttacacaataacttacttctgtatctccagtagcatatcctaaaattccacctgcataaatacttcccatgtcacctgttatcgtaatatttcctttattttcgcagtaatttatctttgtattttctgcgtatccacacattccgataaatccataaatatatttcccattattctgaaatccaacttctgacacacagtcaaaaatagaagcattctctgcgtatcctgcaattgttccaaaaaaggtatattcactgtcgtctgctgtaacattaacgtttccttttactgtcagacttgaaatttccgccttttcaacgtatccaaaaaaacctccaactgctccttttccataactggaagaaaaatccagatttgaaatcacatgtccattcccataaaatttaccactgaaacagtgttcaatatctccggaagcattagcttgtcctatcggtgtccactccacacccgataaatctaaatctgcatcaagcactacgactgcatctgttttttcatcataatcacctgcattgactgcttttgcaaatttcagcaattcgtccacagaagtgattactgttttactgccctgttcttctccttctgcccataccgactctggcagtaataacaaacacattgccagcaccagaaacagtcctgtaatctttcttttcatacgcacctccgcttttccatttgtcagcttattccactctatctgaccaaatcatattgtttataatttatatcatacctttttttctgacaaatagcaatctattcgaagatgttttgagatttttcattccacactgtgtatcccgggagtttggcagtcgagtaattaaatgttcgtaaaaaaagagaggatgtgctctcctctctcttcccaatttttttatttttcctacatttctccaattttctctttccatatttcaaccagtctttccaccgaatatgctgcatttgccggactggttgatggaagtacttccgcttcaatcccaagctctttctgctgatattttcgaaaatacgttccggaagtttttccattacagaagattcgttttacattactatcttttacaatcgcttttaaatccgtcggaactacatttttaatgctgctgtcactggacccaataatatcacaactgtaaatagtatcccaaagcgctacatgatgccgatataacattgctttcttttcttcgatattctttggcaccggttcatttaacactgctgcgattactttccaaaatcgattctgcggatgcccataaaaaaacatctgctctctcgattttacagacgggagacttcctagtatcaaaatttctgattctttattataaagtgccggaaatggatgtgttacatgagtatattcctttgttactgctgcttttttgaccatctttctgtctcctcttctatttctgtccttctttttcatgcattaaaagatatttctctctcgttgcaattccaccacgaatatgccgttccgatttattcctgtccaatacctgacgtacttctaatcccaaagtaggattaatctgaatcagacgctcggtacagtctttatgtaccgtacttttgctgattccaaatttctttgcggcctgacgcacagttcctttgttttcaataatatagcatgcaatttccactgcccgttcttcgatataatctttcaacggataagcctccgaagacgctgtttttacagtgtatgccctggatttacagggtattctccaaactctattgtattattttcctattttccctgttccggattagcacccgtttttccattttcctgttccgtctgcgtatccagcatcattttaataatttctttatctgtctgatgcattccgacttttccgatgtatcccacacagctgattgtttcttctgtatcctctttaacaattccggtatatgctttatacgccttatgattcattgcaagataatgtgccatcattcccgcgtctatactggatgcaatttttgctgcacaggagatctttgcaccatcacagataattcccggaatatttgccaatgtattgtcaatcgttgctttaatctgtgcaacacttcctccacataaataagtgattgcggcagccgatgcacaagaagcagaaaccgcaccacaaaatgcagacagttttccaataaacattttttggtacgtggtcaaaagacctgaaaaaaccagtgcccgatacaattcatcatttctgtaatttttttctcttgcatacacgattacgggaacagaggatgcaattccctgatttccacttcctgaattaataataaccggcatatcacagccactcatccttgcctctgaagcggctgctgcataggctttcatacgagtcactactccgtctgcataactctcacgcagcactcttccaattccaagaccataatctccggaaatcccctcataagcaatatccatattatatcgaatctgtcgttcaatcatcggacgtactaaattcaatggcacttcatctgcaaactgtttgatattctccaaagtaagcacggaacggtctgtcagaccacctccggttgcttcgttctcatcaccgataaaaatcgtttctccatttttttctatttttgcaatattcgtatgtgaataacggatttcaaccattgctgaatctgctcctgctgacacttcaaccataaaatgcaatggaatatccgaatccagaaattcaacttcacaacgtttttgttccagcaattttttcgtctgcgctctctgttcctccgttaccttttctaaaacttccattttattttctgagtgacctgcaatagctcctaaaatacaggctgtttcgattcctgtcattcctcctgaatttggaatcgttacacaacgcacatttttaatcatatttcccgaacattttgccacaatatattccggttcacatcctaatatttctcttgcttttgcagaagcataagccagtgcaattggctctgtacatcccatcgccggtactaactcttcctgcagaatcgctaaatatttttcctgtaagttactgttcattgacgatttccccatctttctacatttttttctattgtaacatgataagataccaaggtcaaaagacatgatggggataaaccaccttttgactttggtatcttaagtaaagcggatattcgcctgactattatcttcttttttattctccgctccgtatccgttctacaacacttatacggcacattttttcacatgccagatacggtacgaaaagcacaatcaaaagcaaaaacggtatacagattagaattggaagtacagtaaatttccatgtaaaaaagaaaaatccggatgtataactttttattaaagtcatacttaaaatacttcccgcaagaactgctactatacttgtaaaaagcgcataatatccgccttcccacatcaacatctctcttaattgttttctggtcattcccactgattcgagcatggcaaattcctgtttccttgataaaattccggtcaaaatcgtatttacaaaatttaaaattccaatcaatgccaacacaaaacttagaaatccaccaacgattacaatcatattttgaagcgtcgcaaattctgcctccatcgttgattttgaagtataagttaaatcatcgttgatattcgtacaataattttccagccagctctctatctgtttttcatctttttttgatacattaaataatgttttcatcggctgtctgccttcaaagtaatttaaaaattctgaagagggaagaatataatttatctcaagtgaaaaatacatctgaaattctgccggataaggcatcgacacaagtgccatcacctcatactctttcgtaaacccattttctccagtcaacgtgattttgtctccaacatcgtaaatcggtttctcgccatcatccgattcgaattgattgaccacaatataatttccactcttgaatttctcccaatctaattcgccctgctcacattttaacttttcaaataccagctggtccaaaccatacatttttgctgtgatgctcccacgctctttatcggcgtctatttcctgtttcatgtcctcttcaccaatcgactgaatcatgtaagcaaaatttttcttccaatccttccagattctctcttccaatcgttctttttcccagtctgataacttctgttcccattcgctgtaatagacatttccgctttctttgattccatcctgttcccgtaattccgtcaaaaaatcactggtgactccatcttccgttctttctgaaagtgccggattatccgttgtcgcatccgttaccatataatcgcttacactcctgtttgatacatatttatccatatcaaatccctttagcaacgtacaaaccgtattaagcagaatcagacttaacgataaggaaaatacaaccaatactgctttttttcgatttcttttgatatttgccagcccaaaagcatgcatggtaagcttatgagttcttctctttttcccttttacctttgcatttacagagctttcggtcagcttcacagcttcgattggggaaatctttgctacgatacggcacggcttaatacagctgatttgaaccgtcaaaaaagaaaagactgccgaaccgataaaaatccatggatgaagcaccacatttgttccttctgtatcccccatacttaaattggcacagataatcggaagtaatcctgcacccacaaccgcacctaaaataagtccaatcggaattcctgcaagagaaagcagatttgcctgttttcttactatttttccaagctgtttttttgtcgttccaattgtctttaaaagtccataaaaccgaatgtctccaaacacattaatgtaaaaaatattataaataatcagatagccggaaaccagaataatgccaagcattacaacaataagtacaactgtttcagcgtctgccttcactccaagatatgcccagttcactcccgttgatttttcttcgaaaccaatccgcttatttaattcttccagctgttttttaagattaaacgaggtcttgaagttaaaatctaccatataacttcctgctatatctcctccatattgatagctctctgcagttggtgcaagctgattgaccagttttttcgaaacacacattacctgtgacatcgaaacacgatctcccttataccatccgcacaggataaattctttggaatatttctttcctcttacactaaaatcaaccgaaaatttctcaccgattttgcacggaacgcccaatgcctttaaggtcaaatcgcttgccacacattcattttctttcttcggcatgtgcccttcttccggataacaaaaactccattttgcctccaactcctcataataagccatttctgtgcgtactttaatcaaaggtttattctctgcatcagcaagtgcaattcgataagaaaccgattttaagcccttgtcttttgccactttttcatattctgattttgttaagtatttatatcctgcatgagcactgcctccgacctgccgcattgtagattcctgatttttttcaatcagacttcctccaatcgtaaacagcgcagtaaataaaacagaggttaatgcaatggctaaaattgcaattaaatttcgcttttttcttgcctttaaagacttcaatgcaatttgattgatcatctttttatttttcacgttcgacacagtctgcaccctctttctgatttggatttttgtccattatctgcaaggtctgttttccggacacaatttttccatcttcaatccgaatgatgcgatccgccatctgggcaatttcttcattgtgtgtaatcatcacaatcgtctgatgaaaccgctcactggtcactctcaaaagtccaagcacatcctgactggtcgctgaatcaagatttccggtcggctcatccgccaaaagaattgccggtttcgccgccagcgcccttgcaattgcaaccctttgctgttgtcctcccgaaagctgacttggaaggctttctaatttcttatttaatcccaaaagcccgatgacttctttaatataagctgtgtctactttgtctccatcaagctcaaccggaagtaccacattttcgtacacattcaagaccggaactaaattatagctttgaaatacaaaaccaatctttcttcttctgaaaatacagagtgcatctttttttaactgataaatttcttttccatctacaaatacctttccagaggttggctcatccaagccgccaaacagatgcaacagggtcgattttccagaacctgacgaaccgacaatcgcaacaaattctcctttttctacagataaatccacaccgtctaaggcttttactgtattttcatgatttccataatatttctttaagttctcgcattttaatacttccatctctcatcttcctttctgtttttcctaatttcttatctaatctcttttgttaatttcagtataacaaagaactctttcgagattctttcggaaatctaacagttttgaaagatttaagactcctgtcctaccttggaaggtaacataaaaatgtacttccttttcccacttctgaatttacttttataaatcctccctctttttgcaaaatctcccgcacaagatacagtccgattccaacgccttcttcctgctgtacttcttttgcccgataaaaccgcccaaatatctttggaatttcttcttctgaaatgccacgtcctctatcacttaccgcaatcacgcaccacatttcatacagcttggttgaaatcaggacttcacttcctgtcggactgtacttcaccgcattgtcgagcaaattataaagtgcttcttccgtccattttctatcaaaaacagcctctgcctcaaagtccatttctatctttatctgaatttcttttttctctgccttcttccgaatttcttctactgcactttcaagtagcggttttacctgacttttaaccggtaccacctctaaaatatttgtttctaatctggaaagtttcgttaacgcctgaattaaaaattccagtttctgtgcctgtgcctgaatctgtcccagcagttccgcttccataccgtcttcttccaactgttccgaaagcagttcactgtatagttttatgtttgccattggagttttggtctgatgagaaatatctgaaatcagccctttgatattagccttttctgtctctaaattctgctttgccattgcagaatcctgtaaaaaccgtttccactttgactctactttggaaagttcactttcatcatatttagactcttcaaattctccacggattccctcatcaagcatttgatttaaccgttcccagtttcttcttccccaaatcacttttttatcactcttctttcctccagatatagccctgaccgtatacggtctgtatatattttgtctcgccttctattttctttctcagccggttgattgtcacagacaacgcattttcatccacaaactcagcgccatcctgccacagacgttccatcaaaatttctcttgtcaaaatccgtccctgatttttcaaaaaaatctgaagcagtctctgttcatttctgcttaaacttaattcttcttctcctttaaaaaaacagagccgttcaaaatcaaatttcaaattctctatcacataataatttggcaaaattgactttatactctgattctcacgctgttcccgaatccggcgtttctgcacttcaatccttgcacgaagcaccgccagactaaatggtttggtaatataatcatctgcaccgagtgaaagccctgtcacctggtcgatttccaaatcattggcagttaaaagaatcaccggaactttcgatgattcttttacgaatgccaaaaaatcatatccgcttccatccggaagattcacatcaagaatgacaaggtctgcgttctcactttcccacatttcttctgccgtttttaaatcatgacagactgtgatttcgttttctttttcagaaagtgccaattcaattccctttgcaagtgccttgtcatcttccactatcataagtttcattttcttttttcctttttatttttcttgtaaaactgcggtaaagcggacattcgcaatccgcttcgctacttgctcatgaacgcagtcgctttgcgatctgtcagtgggagctttcaactcccactgacagaagcatccccctcacccgccgcttattgctctgcgcacttgaagcggtggaatgcttatctgcgttcaaaaagcagacttatgatttttccacaaatctgcttttcgattaccgtttatttttttcctgtgcttctatcatcagccagttctaattcaaactcctctccaaaaaactcctcatattcttctttgtattttttccatctctcctttcgttctaacgttatcttcttaatctcctccggggtgagacgattttcacgcatcggttcaccataaccgttcggataaggttcactatccggtaaactgtctgtataagcgctttctaaatcttcgccttctgcatctaaaatttcttcccaatcaattcccataacgactgtctccttttcgtaaaatcctccgtcttaattttgtttttatattctacggaaatatcacttttgtcaatagattttccaaatccaatggaagaatttatctctctttttcttgtgatcagtgtttcaaagcttccacagaatacaaaactgatttttgaggtatcaaactccattgccacctttcctttatcttccggaaagaatactttgtttccctcaatcatctttaacagctcattcttcattgcagcactgtagttatttccgcctgagccgtactttggttcacacagtttatcgaactcgtcgatgacgataatggcactttccgcctgttcccgtgacatatttgcaaaaatgtcacgaagtttaaacgcaccgctccagccttccattgtaagcattgtaccatcgacaatttggatattcggatataactggcttagtaccctccagatttcggtttttccgcatcctgtcggtccggcaaataatacattgcgcttctttccatgccagaattttgcgacgtcttcaatatcctttaacatgctgttatagacttcatccgtatagttatcataaagtcctgcttttgcatctttggtaaattgaactgccggattttctttttggatgattccacaacctctgatgagctcttctaaaaaatatttaacattgcggatatagctttcttctttcattctaactgacctcctgtgcttttttctgtattctcaaaattttctgtttctttttgttcttcttgatttcattataagcacaagtgccaaaattctcgtaaattttacgacaaaaagagcgctgttttaaacaaacaacgccctcaagatttttcattttttcgcaaaaccggtacgacaactccaccaactaaccacaacagaagcgccagagataataatcctgaaactaccattccaattaaccctaccattttcagattttctgtaaagctatatttgtctcctgctcacacagtgcaatcaatttcaaatcttcttccaatactccattcaattgcattctgacttcatccgaaaattcactccagcatttattaatttcttccgcataatacagattttcatgcaaaataatcaaaggagaatacccaaacagtgtatacaaagaatttaaaatcacagcatccggctctgcttccattcgttccagacgctggtaacgtttgatattaatatccagccgttccgccattttcatttgtgtcaaatcttctatttttcggatacttctccagatatttctatgttgttctttttcttcagcaagccggatatacttccacactctctgatttgcctctttccagttttctccgtgcatcagcataattccctgtctggtcagccagaataatgccttcattaattctatttttccatccgaagtcctgcaccgtttcatacagtcctccacgattcctgttttataatgcacaccggtaaccagataattgacatctcctccagccttttcaaacttcttcaaactgctgtatgaaatatattttgttccactttccagtttactgtagtggctttgattcacaccaaattctctgctcatttctgcctgacttttgccaagctgctggcggtaagacaccagtctttgagatatactattgtgctccaacgttataaacattctccaataatttccaatttttactatattgtagaatgtttttcttgtcctcctgtatacccatttgtgaatatttgtcgaattttggcaataaaaatgggaaaaggcaaaacccttttcccaaaaaatatttattttactgcttcttttaactttttaattaattcctgcacttcttccgtactgattccggcaaaacttctcaaagcacgaagtggagaattttccatcatcttaatcatcatctcttgagaaattgcttcgcttgccgcactgccttcttctccaccaccgatgtttgccatcatctggtctactaaatctttcatgacttcttttgctttttcattttccatcaattcagaaatggtcgtgtttgtatgaatttccatcggaatcttcattgtagattcaagttctactgttttggttaatcgaatgtctctggaagaacttccgattaagatttcataagttccgcttcccgcataccagtcatttacttttgtattataccatgcaaaacttcgtttattaagttccattgtcacagtcttttcttcctgtggctgtaattctactttcacaaagtttttcagttcatttaccggacgcatgactgcatttgttttatcagaaacatagagctgtaccacttcttttcctgccatttttccggtattttttacctttacactaacctgaagggtttccgtatctttgattttttcttttgaaagctgtaaatcactgtattcaaatgtggtgtaacttaaaccatatccaaatggatatcgaaccggcatttttttcatatcataatagcggtatccgacaaatacgccttctttatattccactttttgtccatctcctgggaaatttaagtaagatggattgtcttctaaatgatatggaatggtttctgccagttttccggatggattcactttaccaaataagatatctgcttctgctgcgccaactgcctgtccacaaagatacgcttctaagattgcacttacgtcatctgcccacggcatttccaccggtgaaccgttatgcagtacaactacaacacttttctgtacttttaagatttcctgaatcagataattctgacagtctggcattcccatatgttctctgtcatatccttcggattcaaaggcatccggaagtcctgcaaaaataactgcaacatctgcattttttgcagtttccacagcttcttttaacatcgcttcgtcaattttatcttcttttacatcatacccctgtgcataagcaacttccgtatacgcttttaccgcatccagtgcactttctactttaaaagaattaatatgggaacttccgccaccctggaatcttggtttttctgcaaatttaccaataaaagcaatcttctgttcgccggctttaagtggcaggattccgtcatttttaagcagaaccatcgattcttccgcaattttctttgcgatttgatggtccgcttctaaatcaaatctgccttcctgacgattatctgtatatttaaaaataatatttaaaatacgttctactgcggtatcaagcacactttcttctaatgttccatctttgaccgctgatacgatttctgcatcggtatatccaccgcttcctggcatttccaaatccagaccggcttttaatcctttcacacgttcattaactgcaccccagtcagacatgacataaccttcaaatccccactcatctcttaaaatttctgtgagcagtttatgattttcggatgaaaattcgccattaattttattataagagcacatcacggtgtccggtttgccttctttaatcgcagtttcaaatgcccctaaatagatttcacgaaatgtacgctcatcaatttccgaagaacaggacattcttctatattcctgattgtttgctgcgaaatgcttaatcgaagtaccgatgtttttagactgtactcctttgatgtgtgcccctgccatctcggatgcaagatacgggtcttccgagaaatattcaaaatttcttccacacagcggagaacgtttgatattaactgccggacctaaaataacagaaaggttctgtgcctgacactcatcacctaaggtctctcccaatttgtataataagtctcggtcaaatgagcaggctgtcgcacacgcagttggaaagcacactgctttaatactatcatttgctccaaggtggtctgcctcctgatcctgttttcttaacccgtgaggaccgtcacttaccatcacactcgggattccaagacgctctacactctttaaatgccagaaatcttctccggaacacattccggctttttcttctaacgtcatctgttttacaattgctttaatatcacgcttcattaaaaaataattcccctttctacgttggttttctactttaaactttatcacatctgaaccgttctgaatatcaaaatttctattttttttatacaattatcgtatctttatctatccaatatgtatagaaaaagaagtcacggcaattgccatggcttctttttctcttttcgcttttacttattcttccatatttgcgtaagcacgctctctgtctttttctttaaacttatgagcatcctcaagcatcatatcttttactttcatcagacgaatctgggtacttctctcattttcatccaatttcatagtaatatatttaatattattctgtgcttccggaataattacatgttccagagcgtttactctacgacgggtcttttcgatttccgcagccatcagctgacaggatttctccacttcagccaggcgcagcatatccggcaaaatgtctgccagtgattttaccgcaccatccaaatctccggaagtaaatgcaaaaccgtaagaataaatatcatttgcatcagcagttcttgtctgtgactggaataccggaatatcaacgctcattacgtttttctttcccgcttccagataaacttcctgctttggtgccatcagcgcagtatttaaaatctgttctgacattccggcttttgcaatgacaaagttcttatttgcatttgcgattccctcttctacttttaaacgcagagccatgttttcccttgccaggtcaaggaactgacgcatcagttcatcacgtttatcctttaaaagtttgtgtccttttacggcagtgactaattttttcttctgcttgttcagctccattctggttggatttatctgggtagatgccaaatccaatcacctctttcaacatttgccgtaatattcgtccagatacttgtcatcgatacgtttcagttcacttctaggcagtaaggaaagcaatttccatccgatacgaagagtttcttcgatatcacggttcgcattatatccctgtgaaacatattcctgttcaaatgcatctgcaaattttgcataaattaagtcgatatctgaaagtgctgcttcaccaagaatagtcatcagctctttcgcatctttaccacgcgcataagctgcaaataactggttcattgtatttgcatggtctgcacgggttttaccttcaccaatacctttatctttcagacgagacagagatggtaatacatcgattggcggtgttacaccttttctgtaaagttcacggcttaagataatctgaccttctgtgatgtatccggtaaggtcagggattggatgagttttgtcatcttcaggcatggtcagaatcggaatcatagtaatagaaccattacttcctctcttacgtcctgctctttcatacattgttgcaaggtctgtatacatgtaacccggataaccacgacgtcccggaacttctttacgtgcggcggatacctcacgaagtgcatcggcgtagtttgtgatatcagtcagaataaccagtacgtgcatatctttttcaaatgcaagatattctgctgcggttaatgccatcttcggtgttgcaatacgctctaccgcagggtcatttgcaaggttgataaacagaacagttctgtcaatcgctcctgtttctttaaagctttcaataaagaagttagattcctcgaatgtgatacccattgcagcaaatacaacggcaaagttttcacctgttccacgaacttttgcctgtcttgctatctgtgctgccagctgtgcatgcggcagaccggatgctgagaagattggaagtttctgtccacgaaccagtgtgttcagtccgtcaattgcggatacacctgtctgaataaactcttccggatacattctggctgccggattcattggcagaccattgatatctcttctctcttccgggagaatttccggaccatcatcaatcggacgtcccagaccgtcaaagacacgaccaagcatatcttctgatacaccaagttccatgcttcgtccaaggaaacgtactttactgttggacaggttgatacctgttgaactttcaaataactgtactaaagcgtccgttccgttaatttccagaactttacaacgtctggtttctccacttgccagctcgatttctcccagctcgtcatagtgtacattttcaacaccacgtactaacatcagaggtccggcaacttcctgtatggttctatactctttcggcattttagaagtccccctttcctaatacattcgcaatttctgatgccagttctttttcaatgcggtcgtattcttcatctaatttatcttctgtcacatatttgaaacgtccgattttttcacgaacttccattttaagcagtccctgaatggaagcacctttttccaacgcttctttggactgttcataaaatgctacaaccagctgcatcagcaaatgctgttttttcagtgagctgtaggtatcaacttcatggaaggagttctgatgtaagaagtcctctcgaatggaacgagccgcttccattttcaaacggtcgcctgcggaaagtgcatccatacctaccatcttaacgatttcttccagttctgcctcatcctgaagcagacccattaatttctgacggttttccatccaatccgatgcaacctgtgtattaaaccaatcttccatattgtcaagatacagagaataactggtcaaccagttgattgccgggaaatgacgtttataagccaatgcggaatccagaccccagaatacttttacaatacgcagggttgcctgagaaaccggctcggaaatatcaccacctggaggagacacggcaccgataacagaaagtgctccttctctcttatcttttccaagagaaattacatgtccggctctttcatagaactgtgccagacgagaaccaagatatgccggataaccttcttcacctggcatttcctccagacgtcctgacatttcacgaagtgcctctgcccaacgtgaggtggagtctgccatcagcgctacggaataccccatatcacggaaatattctgcaattgtaataccggtataaatagaagcttctcgggctgcaaccggcatatcggaagtatttgcaatcagaacggttctttccatcagagactgacctgttttcggatccttcagttccggaaactcgtttaatacgtctgtcatctcatttccacgttctccacatccgatgtaaacaacgatatctgcatcggcccattttgcaagctgatgctggattacggtttttccactaccgaatggtccaggaaccgcggcaacaccaccttttgcaattgggaagaaagtatcaacaactcgctgtcctgttacaagcggcatttccggaggaagttttttcagatatggacgtccacgacgaaccggccatttctgcatcattgtaagttcttcttctccgttttcggtttcgattacagcaaccacttcttctactgtaaattcaccggctttaattttttttactttacctttgattccgtaaggaaccatgattttatgatttactacaattgtttcctgaacagtaccgagaatatctccggcttctacttcatcacctgcttttacaactggttcaaagttccatttgatatctcttttcagagaaggaacttcaacacctctttttaagttagttccggaaactttcatgatatcatcaagtggacgctggattccatcataaatactggtaatcaaaccaggtccaagttctacggaaagaggtgcatctgtagattctaccggttctccaggtccgaggcctgatgtctcctcgtaaacctgaacactggcttcatcaccatgcatctcgatgatctcaccaatcagacgctggttacttacacgaaccacgtcgtacatatttgcatcgcgcattccctctgcaataaccagcggtcctgcaacttttttaatcgtacctttgctcatgggaacgaatcacctgctttctaaaatattcgtatcgtgactttaattaatcatcacgtttcacttccaaaaaggatatccgagccaacagcctgctctacggatttcttcacgccttccacaccatcgcctgtattaccggaaactcccggaatacggataacagcagggaaaagctgctcctgaaatttttcgattattttttcacactctgcagccatcgcttctgtaatataaataattccatattcatttgctgcaagtgtctctaatttttcttcggcctcttttcgggatgttaccggaaacgtgtcaagacccagcgccgcaaagccaaaaatgctgtcataatcacctactaccgcaatcttatacatacatttcccttaccctttcccgaatagaatcatccgacagtccgctgcgcttaccggacacaatgattcgtaccgtttttatttcattttcccttgccagcacataagctaccaaaggacctaccgaaaacgactgatatttctgaggttgcatggtctgcatcattcggttgtcacaccaacgttcaaatgcggaagctgattctgcaatcgctcttccaccttctgcatactctgtctgggaaagatactctacaattgcatccattccactgactgctgcttttgcaagctgggttacacttaatgattcacattccgccatcgcacgcttcataaattccatagattttgcggttttctgtgcacgcacggcaatcttaatatcggcaatggcaactgtcgattcagcatactctttaataatgctgtcctttgcctcttttcctgcctgatagacagcttcgagctgtgccttgtctatgatgatatcacaaagctgcccgtctctggtatgaagcagtgcctcataagcttcttttgccgcttccgacattatctttggaagtctggaaaaatctttgcttcttacaatctcaagcatctcatccggactgatggaagtatcttcataataaatatttaaatgctttccactttcagatgtacacgcatctttaattgcagcttttaaattgtgaaacagattcggataagacaatacatcaaatactgacatatccacccctaaatcacggattgtctcccagattttttcctgctccctgcttaatatcgcctctgcattttccggtgtatcggcatctccccagcctttttcctgaagcaactgcaggcactgcacatctgtctggcatgccatcagctgttcaatcaccgctgaatttaataaagatgtctctaacgcacggattcgcgcaaccgcataagtgtattttgtatcaatcaaaacaagttcctcctttttgcggttatcgcttatgaaaataataatacatgaactttatcggaaagttcacctttcttggaatcgaacattgccttaaaggtacagttttcttcgattcctccatataaaagaacaaaaccgccgcggatattatcatttccctcttttaacagagtcagttttccgccttttttggctgcaatgtccataatttcgctttcaaaattttccggcattctctttaaatcattggaagagaagcagatgcttccctcctgtggcagaacgaattttttcagcattttgcggataaattcaaaataagatttatcatctaacaccaacagtgcttcataaacgtcatcgagaatctttgcaatcacttcctgttttgcctgaagaattgcttttcttttctgcaggtcacgggaagatgctgctctttcttttaccgcttcgagttccgcctctgattttttggagatacgcccacattctgcctcagcattttcttttgctgtctgcattactttttctgcatcctgcttcgcttcatccaaaattttctttgcacttagctctgcttcgttcagaatctggcttttcattttttctaatccagtcatccctgcgctctcctttgctctttttctttcctgtttctatttttcgccctataagttctgtaaaattagaaggacaggtttgttactgaaagaatagaaatcagaagagcaaggattgcataagtttcaaccattgcagggaaaagcattgctttaccaaactgttccggtttctttgctacaataccgattgctgctgctgaagtcattccctgatatttaccggaaatcagacctacaataccaatcggaaggcatgctgcaagtactaaaagaccctgctgaggtgttaaatctaacattccgccacctaataaaccgattttagaaagtgtaataaatccaactaacagaccataaataccctgtgtacccggaagaagctgcataatcagaactttcgcaaatttgcttgggtcttctgatacaactcctgaagctgcctgtcctgcaatacctacaccgattgctgaacctgcacctgctaaaaatactgctactgctgcaccaagtaatgcataaacaattcctaactgactcataaataagtttcctccttaacatccacgtatttcgtagttaatttaaatgggttaaatggctttccgccaccctcgtaaaattttccgaagaattctacaaactgcaaacggtttgtatgcacataagcacctaacaggttaattgccagatttaatgtgtgaccaatgataaatacaacaataaatccgattgcaccaagaattccatctcctaacatacttcccatctggtttacaaccgatgcgataactcctgtcgcaagaccaagagctaacagacgggaataagaaagtacatcacttaaccatcctgttacgttataaatatcataagctccaagtgccagacgaagtgcaacatttttatttgcacgtccagacatcagaagcagaccgactgcacctgcgattgccattactttacctgtcacagaaactgccggtgggaatgttcctgccggaatctgtgagatagaagcaaagattgaacttggaagcagcattaaaatcaaaccgattaagaacacataccagataataacatcacagaagaaatccatatattgtttttcttttgctaacatatatcctttaattccaagtcccataaacaggtgaatcacaccaaacagcatggagtacattaaaaggcgcatcggatcgttaagaggaacaaaccatactgccttaatcaatcccgttgacggcacatctacgtggaagaatgttcttgcaaccacgtcaatggcatcaccaaagtatccgccaaacaggacaccccatactaaagtggaaagtccacaatacataaacattttcaatgacttatacattccacgctccatgcgcgggaattttttgattgcgatgaaacaggccaggaaaataaccagaccataagccgcatcggaaagcatcagaccgaagaagaacacatagaaaaatgacataataaatgtcgggtctacttctccttttttcgggagaccataagattccagaacaccttctacggattcagaaaatccattgttggaaagcacaacaggtgcttcttcctcttctttgatttcttcaatttcgacaactaaatcatagttctcttccatcgctttttttactgcgtttgctgcttttttcggtacatatccgctgattaaaaatgtcttttcagactgcggaattgtgcctaatacttcatatttctgtgctcttgtacggaaataatcggaaatcacacgcaactgtgcacgcttatctgcacattctttgatatgattctgacaaacttcaatctgtttttccaaaagtccaatttcagcagtcagattttcctgctctacttttggaatttcatcacacagctgagacggtcttgcaaatccaccctgtctcaatgcgttttcaaccagttctgcttgctctctcagacaaagtactactacataagtactgtctctgtctgaggaaagaatcgtaacatctacaccttcgacatccggtgcatgttctgctgtcagtgtataaatttcttccagcgtcataacacttgaaaaacttccaatcagagcttttacgctgccggtaccttcaaaattcatcggtacatccagactaagccatggacttaaggcttctatctgattttctgttttctgaatatttgcacgacattctgcaatttctttctgccagccaaccaaatcagataccacatccatgatgtcttctttttttgaaatactctctgcgtatttttctttttcaattagtgccttgccctcaagactggacaaaaaggaagttttttccggtgcatattcctgaagaatctcaagtgcctggtctgcagatgacgctttcttttcaaagagaattcttgttccctgcgtatcctgcttctcaaaaccactttcgtcctcaagcacctgactgacttccattactcccatggactgcagtctctcaaggatagatttccggtcctttttcagtgcgcagatactaactcgctgcatctgcaatactgccatgttcgcatccctccttttttgttttgttaaactttaagcggatattttttatttctaccgcttcttccggtgcattttgcactcagattaattcggaaataatcaaatcaaccgcttcattcttgcggcctattgccgcagctttcatgctttcaatttctttctccgtctgttttaaagcttcgtctgtgcgttgcttttcggagttctctgcagattcacgcaatttttccgccttctgctgtgcttcagaaaccatgtccgcatacagttttttggaagcttcctctgcttcctgggatatttttaagctctgacgtttggcttcctgcaccatttcatctgcttttttctctgcatccctgatttctttgattgttccttctatcacagtatcaccaccttcacatattttaaatattactatgctttatgcattttgtcaatattttaacgtacaaatacacattttacatcattattttagaataagcacaacacgcaagaaaattcacgtcatactacccacctatttctgtatttttttgtatattttgccaatttccattcaaaaaatgaaggtgtttcttcttattataaatgtagtactttagcacaaaaaaatcgccctgtatttattcaaaaatacaaggcgatttttttactctatttttttatctttacatttcgattgtaaagcggacattcgcaatccgcttcgctacttgctcataaacgcagtcgctttgcgatctgtcagtgggagctttcaactctcactgacagaagcatccccctcacccgccgcttagtgctctgcgcacttgaagcaggggaatgcttatctgcgttcaatttttaatcatacaaataattagcataccgctcatcggaaatattttctgaatcaatccattccattccaggattaatactttcatcattttccattccaagcgctgctcttgctgctgctacaacagttgcatagcccattccataagcattttgtaccagcactccgacttcttttccagacttaatggcatctttttgtttctttcccgcatcgattccgacaactgccacttcttttccggatgcagagattgcatccagcacatcccctgacacattttcattggtacagaaatagccttttacatccgggaacaattttaacacactttctgccatctcgctgacagaagtttcttcattttgatgggaaatatttacaatctcgatatccggatatttttctgcaattgcttcagtaaagccctgctctctttcctgacagttctgagcactttccacatgcgtcatcacagctattttcccacttccgccgattgtatctgcaagctttacagcagcttgtactcctgcctgatagttatccacaacgcaggttgcattgacatttccggttttcactccagaatctaatacaatcaccggaattccattttcttctgctgcttcaagctgagcctgacaggaatccatgtcaattgcagaaaggcataatacatccggattttcaccaagcacagcatcaataatgttaatctgatcctctacatctgtttcatctgacggaccttcaaaggtcagctttattttgtcatcacctttataacccagtttttcatttaaatcagccactgctgcgtccataccgcgcttaaccgaagtccagaaaccgctctttgtgctctttactaccactgcaatatgacttccggcctctaaattaatttcttctaaagaagtataatcaatcgagcttccattttcacgaagcttttgcatggtcaaatcatccttcatatcatcgttctcggcatctgtattttctgactcgtcaccttctgattttgtatctgttttgatgtcggttgatacattctcttgattttccgtattctctgcaccttttgagtcattttttgatgtatcgtctttttcgttctcgttatccttgtctgtctttgtctctttttcttctttcacactagaacttgccgctgtttcactcttcttgctctggcaggaagttatacttcctgttgcaagcactgcacataataaaactgcaactgctcttttcatacactttttcctccgcttttttctccaggtgtttctattcttctcactacactattttctcagccgataactcctgtttatatgagtgagttatcaaccagtttgtatcccaaccacgttttcattatacacgaaacagtttttgtgtctataggtattttgtgataaatttgtgaagaaatgcactaaagcagccaggttcaacgtgtaattaagcaaaatcgcgtatttttatttatttcatgctgtcaagctaccggaaaatgctccggcgtcggaagttcaaacttcatctgttttttcgtaatcggatgcgcaaaatttaacttatacgcacagagtgcaatctgcacccattcctttgttccgacaaattccggattgtacttggtatctccataaagtggaaatcctgcattagcagtctgaacacgaatttgatgatgccgtccggtaaacagatggatctccaccaatgccatttcatctttttcttttaacacctgatactccagtactaccttcttctttcctgcctcagattcttttgcaattctcgacgtattcttttttgcatcttttatcatccagtcttctaatctgccactctttttttccggtatcttagatgtcacagccagataatacttatccatctttccgtcctgcatttgtttattcaatcccgccgctgattttttattctttgcaaaaacaaggattccctcaaccggctgatccaaccgatgaatcaccgcaagatacagcggctctttttttctcgccagatatccgagcagggcatgctccatatcctgacttccaacctgtctgctctgcaccggcatgcccgctggtttatgacaaaccagtaaatccttgtcttcataaagaattgtgtcctcaattactgtatatcccattttatttttcctcgtctttccgtctccttaatgtattctgaaaattttattcttctgcgcacacaaggacaaccgccataccttcaacttttttcagatacaacggttgccctaatgatgttctgcgttattcaattttaataattcctctcttttttattatttgtattgttattttttatttaacactaatacctgttcttataaaaaatttggaatgataattggttatttagttcctcttaattttattttactatattcaattatcaaatgaaatatcttttccggtttctctctttattccccattttacaacttttattttcttttcttagaatatagattggatttctttacatccttactttttattcttagaaagttaaaataatattgctgaaagttcatatcatctatattgataataaaaagcttctttcaaatatcccgagcatttgctttcaaaacatttctttatatattttttcttgatataaagttctcaggaaatcaaaacaaatattttcgattataagtatataaatatctatagataccaactgattaaaaccgactttctattttttactctatctttgtttttcttgatttcatacctttgaaggatatataaatactctgttttttcaaaatatatttctttacatatatcttgaaacctttttatcatcttttgtggtaatgattcaatatgaggacatttttgatattttacctgatttttatttttaaaatcttattttggaatttctgaaaatttcctaatggaaatcaggtctttcttagggaactatgccttaccactctcatactgataatttgttgtctctgttatttccaatggacgttacctccttatcaatatttcacgattccaccttttactttatccttagtacttctctaattatgatttattcctattatatactctccatacacttaaggaaaaatgataactatcgtttgtaccttgtagccaacttcctaaatagatttctcttctcaatatctaggaattggttatgtagtaattggtgttttcttttgatggttatatattaccatgctaaagcatatttgtcaatatattttttataaaaagttttatttttagtaatttattttttatttgatttttattgctgtaaattgtggattattttttaaattatatatacaatttattttatatctaatctttcgagcaattacggcaatagctctataattacacagtaaagcggacattcgcaatccgcttcgctacttgctcatgaacgcagtcgctttgcgatcaaaaagaggatgccattctcacagcatccccgttttaagtatttatcctctataatagttgattaaacagcctttcaagataatctctctctcatcatctgtcaaatcgcctaattttaatgtaaattcttttaatttatcaccgactacataagccttgatttcgtcccatttttcttctactgcccggcgaatctgcggaacaaagatataatctttattcttaaacggcagttctccgtccgaaatcaagaatggaagcatgccccagttaatcagattggaacggtaacgtttggttgcatactcgtttgcaatatttgcccatcctcctaatactttctgacaggatgccgcctgctctctggcagagccgtcaccaggtttcactgcaaaaatggtacttccgattccggtgttttcactgttcatgtccgggaaagaatccttaatcttatcccataccggttttaattctgcaactgcttctaatgggcagtttccttcttctcttgctttttccgctttctggacttcttttgcaagaggaacataatccgggtcttttcttgataatgcaaattcagccagtttcagtggattagaacggaaagaagaagtttcgccggatggaatcagttcatccgttgttgtaaccgggtcatgaatttcagagactactttcaataccagattatcggtcagtgcacacatttccggccagtctttgatatttggaccaaactgaatttctgtgttcgggtctgctatacccttactgtcaaagactctgttttcataaattgtcttatcaaagaaataacgcggtttcgtatattttacatcaaaatctgctgcggaagtaaggtaccccttatttgctgcagttgctgcaatggaacgtgcatccatcaaagcgacagaagaaatctgaccattttgaatcttagaaccttcacgatttgggaagtttctggtagagtgacgaatactaagcgcattgtttgccggtgtatctccggctccaaagcaaggaccgcaaaacgctgtttttacaactgcacccgtctgcattaaagaagccagcacaccattttttgcaagttccacataaatcggggtacttgccggataaatgcttaaggtaaaggcatccgaaccaatgcttgcaccttttaagatatcagctgcatcacagatattttcaaatccaccacctgcacaacctgcaataattccctgctccacataaagttttccgtcacgaactttatcttttaaagtaaatggaatcttgccgtccagactaatctgggctttcttctcaacatcatctaaaatatcatataagtttgcatttaactcatcaatggtataagtgttgctcgggtggaacggcattgcaatcatcggttttacctgacttaaatccacataaaccatgccgtcatagtaagtcactgcgcccggcgcaagttctttatattcttcacttcttccatgaacctcatagaactctttaatcttatcatccgttacccagatagaagacagacaggttgtctcggttgtcataacgtcaattccgattctgaaatctgcacttaaatttgcaactccaggtccaacaaactccattactttatttttcacataaccatttgcaaatactgctccgataattgcaagtgccacatcctgtggtccaacacccggaatcggttttccggtcagatagacaccgacaacctgcggacgacgaatatcataagttttagaaagtaactgctttaccagctctggtccgccctctcccattgccattgtaccaagcgcaccatagcgtgtgtgactgtcagaaccaagaatcatttttccaccgcctgcaagcatttctcttgcaaactgatgaatgactgcctgatgcggcggtacatacattccaccataacgttttgcgcaggtaagtccaaacatatggtcatcttcattgattgttccaccgaccgcacaaagagaattgtgacagtttgtcagtacataaggaatcgggaatttttccagtcctgaagctctcgccgtctggataattcctacgaaagtaatatcatgagaagtcaatttatcaaatttaatctgtaaatcatccatattgccggatgtattatgtttttcaagaattgaatatgcaattgtctctttggaagcttcttctttggaaacaggtgctttgcctgtcaaatttgcaattactgctgatgcatctttattatcttctacaatttctgtgccgtttaccagccatgcaccgccattatacaacttaaccataaccatactccttcattattattggtgtattttactagtgaactacccatcttctatatgtaatgggcttctaaggagctgacgctcccatttaagaagtctgatatttaagtttccacctaaccaatcaggcactccttattcttacaggcgtgtccacctcgcctctgctgtataggatattcctatccacaacactacttttacgctctaattataaattttattacggtaaaatgcaagcattttatcactttattgtatgaatttaattgtatacatgagtgcacgtattcttttaaagcataaaaaaatacttcccgacttttttaacaggaagtacttttcttattttctatcgtgaattacttggctgcaagcaaccaagcttttcgcttaaatcaggaaactatatcagtcctgattgttcataaaatccatgtaactggaaaccataagcgcaatcttaaaggtcaatgcgtcatcaaatacacggatatcaagtccggtgcttttctggattttttctaaacggtacacaagagtatttctgtgcaggaagagctgtcttgatgtctcggaaatatttaagttattatcaaagaatttattaatggtatttaaagtttcatcatccagagattccggaagctttccaccaaatacttctttcatgaacatttcgcacagaggcattggaagctgataaatcagacgaccgattccaagattattgtaacctacaatatttttttccacatagaaaatctttcctacatcaagtgccatctttgcctctttgtaagagcgggatacatctttaatttcatggatgatatttccataagaaactctcgcttttgccatcgcctcagaattgagcatatctacaatcattcttgcaatcgcttcgatggattcataatcgtcgctctcttccagattacgcacaataataatatttttctcatcaattgccgtaataaaatcattgcttcttgaaataaacatatttttcaggatttcaatcgcatcctgatctttctcgtttcttatttcaaccagaataaccacacgttttgcttctaccggaatgtgcagtttttttgctctgttatagacatccacaagaagaagattgtcaagaatcaaattctgaataaagtttgatttatcaaaacgctctttataagccacaatcagattctgaatctccgcaactgcaacacgcccaatcatgtatgtgtcttcgtttccaccttttgcaatcaatataaattcgacagtctgaccatcataaattttgaagaaatgatacccccttatgacctggctatctgccatagattccacaaaactggatatatccccaaaatcctcatcttctatcggaaaagtagttgaatttactttgccgtctacgtccatcacacataaatcaattcttgttatgcttctcaattcatccagtgtcttttgtatcacctgacttgatatcatattgtatcctcttttctctgtatttttataagtttctgtcgccgtaaaaccacatgcctttcggcgtgtggtagttcacatcaaaatgcatattatcacaaaaaaacttttcgttattttttatataatatcttattttactaaaatttgcaagaaatccaacagttttttgaactgccccaaccgactaatgcggatggggttttctgctctatagtagataaaaaaactgctgcggaatttccgcagcagcttgaattatcgtgaataacgaacaattagttagcgataaccagttctgtttctttatcaaatacatgaattttttccatatccagagcgaatttaactttatcacctgttctggcagttgtacgaggatttactcttgctgtcagatggaatccttcgatatcgaagtataagtaaacttcagcaccaagtaattcataaacagtgatgtcaccttcgattacgctttctggatgagcagcgatagccatctgttcgtcagatacatgttccggacgaataccaagaacaacagtttttccatcatatccgccgtcgattaatgcttttttcttagaagccggaacagacagagtagttttaccaatctgaagtgtaacatcttcaccttttacatggcaaacagcatctaagaagttcatctgaggagaaccaatgaatccggcaacgaacaggttgcatgggttatcatacagattcttaggtgtatcaacctgctgtacaacaccatctttcataactacgattcttgtacccagtgtcatagcttctgtctggtcatgtgttacgtagataattgttgctcctaatctttcatgaagtttggaaatctcagtacgcatctgaacacgaagtttagcatccaggtttgacagaggttcgtccataaggaatactttaggttcacgcacgatagcacgtcccatagcaacacgctgtctctgaccaccggaaagagctttcggtttacgatctaacagtttttccaggtcaaggattttagctgcttctttaaccattttatcaatctgatcttttggtacttttcttaatttcagaccaaatgccatgttatcgtatactgtcatgtgtgggtacagagcgtagttctggaataccattgcgatatctctgtcttttggttctacatcgtttacaactttgtcaccgatttttaatgtaccaccggaaatttcttccagacctgcaatcatacgaagtgttgtagatttaccacaacctgaaggtcctacgaagatgatgaattctttatctgcgatttcaaggttgaaatctttaactgcttcaaaaccatttggatatttttttgtaatatgctgtaatgataaacttgccattgttctcttcctcctaattgttacgttttcacgcttatgtttcgttttccacgcttgttctgctgttttaaacgtttttgtctcgttttcaactgctatcagtataccactgaccacacacatttttccataggtcaattaaacaaatattatcacaagtcttagttagcctctccaacgaaaatttcgccattgtcattctgccgaatttcccttcttcaaaatatgcatattgcacaattttgattggtaagacctgttttaaagcaagtttccgcgtttttttcttgtaaaattccaatttttttcttctttacagaaatctttttctttcttatactgttttaagacaacaatgtaaatctatgttactatgtttcgaaattggcaaaaacagaaagcgcaccaacacttatgcacgaaaggaaaattactatgtttcgattaatgggatgtatctataaagacgcacgtattttaaaaagcacggttatctgtgatgaatcagcttcaagcagaactcataaaattttctccggactcaattttatctgtctggaatttgaccttgaaaaaccaatctggctcgaatccaacatcacagattttcagcgtcattcaaaaacccgctttacgcaggataacttcattgaggaacttgattttgactatctctccattgaagtaattgaagagggctaactcaggataattcattagaagagagataatttattaattaaagtcagaccagttctcttacgaccaaaaacagggacacatcgctttcgatatgcccctgcccttttctcctaaatgaaatctattctaactcaaaaactctttaatcacatcttttacaatcttctcctcctcttcatctaaaagatgccgatagcgttcatccgtaagcgcagcttcccgaatcctcgcttccacctgttccattttctgctgctgactccgtaccgcagacggactctccctgcctccgtttcttgcccgctctttctgcgctcgtaaaagttcttccctgagcttctgctcctgctgtctcgccttactgcgcgccttcctgctcattttttttgcagcagcctttttcgcctcatttgcaatgggcggttctatcttcacaattcttcctgccgaatccttttcattttccatataatccagcagattcgtctctatcatctcctcctgataggcaatagaaaaaatcaggcgcagcattccatttactgcaccaagcaccacagttgttccaatcagcccctccatagccggcatgaaacttttcacaaacggaaacgaaagtgtcataatgcctgtccctctcacctgccatacgccaactgcagatacaaaaaaagagagaacaaaagctgtccaggaaaatccctttagcattcttacggaaatcttcccaatctttcgttctctcagccgtcttgccatataaaccgacggattgtgtatcgttatgtgattctgcgtatccctctgaaattcctgcagatacgcctgcagccatctgttcttgacctttggaatctgctgtaaatcctttaagactccacggttgcttttgtaaaccaccagcatggtgatgatacttaccagctcaaaaagccagattccgtaataaaacaattccacagacaaccctcctagtccgatgcacctcttctgcatctttatgagaccattatatagcagagctgtctgtttgaaaacaaaaatcgtacgacaaattcagtcatccatgcctcgaattttgtcacacccaccaggcaaagcggacattcgcaatccgcttatctgcgttcaaatttccgttttacagcatgagaagcagttcctctaccagtttgacagaatgtaaaattgcctgtctttcaaaagtcggataatccacctgtgcgctgtcatctgctttgtcagaaatcgcccggataatcaggtatggtattttatttaaatgcgctgcctgtccgactgctgttccttccatctctgtacaccagccattggttctctcaataatctgatttttcagagccttatctgccacaaactggtcaccacttacgactcttccctcaaatacactgatttccggatttactttctcgcaggctgtctttgccagttttcgtaaagtttcatctgccgggaaagcatgaacatccatacgcggaacttgtccaatcggatacccaaattctgttgcatccatgtcatgatacatcgtgtctgtggaaagtacaatatctccaatgttgatttctgcttttaaagaacctgcgattccggtattaataactgcatccacctgataatcatctgctaaaatctgtacacagattccggcatttacttttccgattccggaacgaaccacaacaacttcttttttatttaatgttccatggaaaaattccattgcagctttttcctttaccgttacatccttcatctgctcttttaacattgctacttcttcttccatagcaccgataattccaatacgattcattttaactttatctcctttatttcctttatcttagcctttttgctattttcatcataacacacttgcaaataaggtacaattcttaatccttaacttaataaagggtgcagactttttcgctctgcatcctttttcctgattttcatccttaccttttctattctttcttttcagataagtgttctgcctcatcctcatctttttcccgcttcgagtttatcacagaggcaattccatgcagaatcactgctcctaaaattgctcctcctgccagaattttcccataaactccagtcagcacaagtgcaatccctccgacttttggaatcgaataagcaacctttccaataaaattatcatacggcgccgggttcatatcttttgttgcattagcatcaccttttgtgataaattcacccatcagtacacgattttccacaacgcggtgcgtaataatagaagccgcatcctttgttccataaaatgcaatcacatcatctacctgaacatcctttggctccatctctttaatataaaccagacttcctgttggaatcgccggctccatacttccactgattactgtataaacatgataatgaaatgcttttggtacggtaagcggaaggcagattacaattaatagaattaataaagcagtgcccagtgcactgcacacagcagccactgggcttttttttgttttttttgtattcaagaccaataagtcctttcgtcatgttgtatgcttatttctttttagccatgtatttctttaataatacacccattccggcaagtactgcaaccccacagatgccaatcgcaacacctgctgcaacaggaaagccttttttcactttcccctgatttatatctgcgtctctggaaagaggagtctcatcttcgtctaaatcctgaatctcctgtgttccctgtggagtctggtcttcttcaattgtctgggtatcctgagtactatctgttcctgcgtctgtatcagtcgttgtatcggtctctgttgttcctgccgttccggcgtccgtatcagtcgttgtaccggcatctgtgcctgttccggtttctgtcgttgtaccagctcctgtaccggttgtgcccgtaccggttgttcctgtaccggttgttcctgtaccggttgtgcccgttcctgttgttgttcctgcggatgtcgtagccggtactgtaattgtttccacatttgttgttcccggaacaactgttgttacagttgttgtctctcccggaatcgttacaaccgttataccgattggcgtataacggaaggtaaatacattttctgcggaattttctgataacgtctttgtaagcgctaatgcctgaggagtatatccttccacatactgataagcaactaccggtttgtcacccacatttccataataggtattgcttgcaagcagttcctttccatttgcatcctgataattgactgtataagcaacctgatttcctttgattccataagcaactacataatcggcatcgccttttaccgtaacactgtatctcgaagcttctaattcatcggtttcactgttatcacgtccactcttacgaagcccttttacataatatttatcgctgttatttaacgttaccacaccatctttctgtacatcgaaagatacgaaagctccgtattttagattgctcatcacaatcttacctgctccgtctgcaaatgtaccttgatttccggcatagaatgtaacggtataagtatattcgtcatctgcgaaaacagaaagcagagaacactgaaacatcatgcagaaagccactacaaaagttaaaatctgtcttaacttcttcactgtcctcactcccctttctcatcctcgcgacgtctctttactgccaaaaccgcgataatcaataccacaattccactcaccagtgcaatcgcactaaacaataatgcatgcatggtatcaccggtctttggacttgtcaccgctgtttttcggattgtcgaagattttccggtcattgtctttttgactactttatttttacccttttccacttttgtctttttggaaactttttcaactgcaaaatttaactgtaattttgcaagtgtattctgatatgcatttccctgagtttcaccctcaagtccgacttctaattcaactgttcctgtttcattcttatccagacgatccagatagaaataatcttccatggaatttgttgcctgatgaagaccttcttctccgcttttcttatcctctccacctaccgtatcactgtcataaagtacggtttcttcaccggaaacatctttataagaaagtttgtaagtataagcgccattctccgcctgactctcatcttccagactcttcaggatttcattggacatataccagtctgtctgaatgctctctgagtttttaattttcacaccaattttcatggtatcaccaggaagcattccataaacttcttctgcgatctcttttgagctaaagttactgtttagcttatcattcttaaaatctaccgtccagtctttactacttgtaatctcttctgctttcgcagttgttaccgtgccaaatgtcataacagccgccatgaccaggcacaaaatattcttttttaacatatcgtgcacctcctgtggctactgtaagctgatactgtttccgtcttctgagactgtcacatcaatcccccatgcactcttgattgcatcctgtgcattgtgggtctgtacggcatcggcttctgcatcaatcgtaaaatgatatccatcgtattcataaatggttttgatggtcttcttgccctcttcttcggaaaccacctgttcctttacctttgttccgatagaagggtcaactgttaatgtatcactaattgccggagcgctttctcctgccggcaaaagcctggtataataaagtacggtacgctctcttgttgttgcactctcatcaatcacccagccattgtctgtgagcagatttaaatcaatcaaatccggagaaagtctggtatttttatttccgtctgcgtcagtccagctctttgtaagaatgacccttacaaatgtatcaatcgagccgctgttttgtacggttaaggcttcatcgtaagcttttccaagcgcaaatttctcatcttttccaaccagatttttaagaagttctccatgttcttcaacccactgattatccttgttgtaatctctcttactgattgtttcaccattttctaaaaggctgataccaatctttgaaacctctgcctgcactgcataattctcactgtaataagtcagtgccgctcttgtacttcccacggtactgccaagaattaaaagtccggccaccgcaaacaggaaaacgggctttacagaaaaggattttttcttctttttcattactcacccacctcctcagtctgcgcaacatctgctttctttgtccagtctgcacttggatttccctctacatctaagataacaggtgtacattctgaaacaacaattacattaaaatcttttggaaggttcatgttactgatttttaccaataattcttcgctctttgccccaggtgctataacatcagaatagtaataatatccgtcatcccccggcgtccattttccactctcatcggagtagaccagtccttcctgatactggcttccggcaaatacttttactcttacataacattcgtaatcaccggtattttcaattttgatatgcttcgtccaatcactgacctcttcatccggaataacctcggtaaatccaagacttaattcctgtccaccctgtgctgtcacataagtggtaaagtaagccatggcacttcctacagaaagccctgcggtaagtgtaagagctgcagcagtcagacaaagcgttttcttattcaactttttcttcattgcttaacccctccccttattcctgtgcctgtgtactgtccgtttgctgttcccagtcccagacaccatcttcggctgactgtttctggtcatctgcggtttcctcatttggagtaaattcaaaatgattgacaacacttgaacctccatttaatttaccatcatactgattttcaaatgctgtggaaaccatttcatccgctacgatttgagtggtctgctctgcctctcctgttgcctcataacttgaaccactgtaaacttcggttaccgttatatttgcgcccgccggaagttcctttatcacaacactctttgtgcctgttccatcaaataccatggaaactacatcactgtaaacgatttctccatttacttctgcttcaatatcaaatacaaacgaagcacctttcattgtctcattataagaagttaaagttttatcgatttcaaggtcaccatatcgttcctgttggtctggttttaatcctgttgatgtatcataaagccactcgtcgcttccggttacataatactgattattcggcagggaaatcagatacggtgtaaaactgtaagtataatatggagactgcacttcttctgcctctaccagatacattccgactgaaagcccatccacactgcccttgcctccaatcagattatcaaaagctgttgcctctgtctggttctcttctactgccttcactgcactcttggctttctcttcccattcttgtgctgttgtcttgctgctgatggaatccagtttcaattcctcaaatccggctaaggcctgatactctccatattgattcacatctgctaccttatacatgcgaaccggaattgtcatattctcccctgaaagttccggataaaccgcatccagctcaaatttcacagaacactgccggtcagtttcaatactgatagcagcctgaactttggacattactacggtggaaagtgtcaacaccagagccagagccaatgcgcttcctttttttagttttttcttcatcttcacatttcctcccctctgataacagataagtaactatcctgtactgaaaagtctttcttgttctttcttattcttttttattcttttttgtgtttcttctttccaggtttaatcaggaacttcatcaaaagtattacaagtaaagttaccgataatccaagtatcagataaatcatgtagtaattctgaattgatttcaacatggattctgcggctgtagattctatctcttcctctccgttatacggtactcttgtgccacgaactaaaagtctgtgagagtttacaccgtacggcgtacaggtaaatagcgttacatgatcctgaccctcttcaatctggagagccttttgaagcgtctcattgtcatccttatccaccatatctaaaatctggtcaacctgataagcaagcgtttcatccaaaacgtgaatgtaaaacatgtctccacgttctaactggtcaatatccgtaaacaatctggcactcggcagacccctgtgtgctgccagtacgctgtgtgtgctctccccaccgattggaagcttggttccatttaagtgaccgattcctgtctgaagcacatcatccgctgttccatgataaatggacagctttacattaatctttggaatggatacatatcccatgacaccatcatttcccacatttaaaatctgccagtattcggtatttttaatatcgtctccattttctccaaaaacatcaccaaatatattgttatggataatcgtatcattaaaagcattcgctttttcccattcctttgtaaaatcctcttctgccatctttccgattaactcttcataagatgaaatcaattgattctgccggtatgtattccactggttagaaactgtcggataaatcaagattgcaaatcccagcaggaacattaagccaaacaaaatacctgaaatttttctcttcataatacatccctactgttcctttgattttctcttcttatcataacaataaagtataaggataaagcctcctgttactgccagtccgataactacccacaacccataattggtatggagactgactcctccaagtggtgtggatgcctcttctatatcggctgtcttgtaatctactctgtgtcctcgaaccagaagtctgtggctgttaactccataaggagtacaggtaagaagtgttaccaaatctttctcttcctctactgctaaatcatccgtttcttttggttcaacgactgaaattttatctacttcatagcaaagcacgtcatctaatatatagagaagaaaatggtctccctcttcgagtttatcaagatctgtaaaaagtgtagcactcggaagtcctctgtgtgcagaaattactgcatgtgttcctttgcctccaaccggaagtgaacttccttcaagatgaccggctgctttctgaagcacctcgtcttctgttgtatgatagatgggaattttaatattaatcttaggcacttctatatatcccatcataccatcaccaccaaggttcaaacaagaaaaataattagaattttctccatcggaagcctctgcgactgcaaaagaatccggaagaacggatggctgaagagaatcattatatgcatcggcattttcccattcctgctcataattaatttctccatctttttctttctgcgcaacaacttcttcataaccggatatcagctgcttctgcctgtgattgttccactgatttgcaaccaagggatacaacagcaaggacaaaccggctaaaaatataattataatcaatatcgtagtaacttttttcttcatccgggctctccttattgttgtattttttgtcaggtttcaattttctgtgaaatgaaaaaccaaggcgggcgagccgccctggttttttcacaaaataggcatttcaattgttacttattctatttcttctatttcattatttagcagattttttgcgagttgcgaagaataaacctgctgctgcaatcataactacacaaccaccgattgtgaagattgtagtaccgataccacctgtggatggtaagttggaaatcttggtgttgacgatttcaattttttcaactgttccgattgccggtgtatcatcagttactgtgaaagtagatcttacagtatggtcgtcgccggaaatagtagcaccatttacagaaatagaccaagctgttaatttacctgttgtttcgtcgattgtagcatcgattacgattgtgtatacggtatcatttaatgtgtatccgttaggagcttttgtttcttttaagtaataagtaccggctttaagacctgtcatggtcatctggccatttgcatctgttactacaacaccattaaactgtttgttttccggatatgctgttccatatacagtttcaagatcggcatctgtgtataaagtaaattctgcgccggcaagttttactttctgttcgctggaagttgttccaacttttgtgatgagttcatttgttaaagaaccatctgctgttccgtcaatatcaaatgtgtaagtataagttttgtcgttagaagaaccatctttgccatctactttagagtcttttgtgaagtttaaagtagcgtcgttgacatttgctacaccatttaatgctgcatcctgatttactgttgccgcataagttacaactaatgctttgctctgatactgattcagtgtatatgcattatttacaacaaaatcaactgtaatttcattctttgcttcatttactgttaatgtgtaatctgttcctgctgttaattctttaccgtctgctgtaactttcaggctgttttctttataagttaagccgtttaatttatccacgatgttgaacttcggataatttccaccgtagtaaggaattgttgttgaaagttcataatttactgtatcaccaatgtttactgtgttacccttaactttgttttcgccttcaacgatttttttgtctaaatcaggagtatcacttactttagcccatgcattttctgtatctgtaacatctacttcgttgaaatccattgctgtttttccatctttgtttttgtatactacagaaactaccaatggattataaattttattttcagcacctgagataacaactaaataagaacctacaggaacttctgctgtataagtggttccatctgtagaagtcatagcatattctgtacctgcaacttttgttgcatcaataatgtcagcgagctgagctgagtctacagtaatatcatcagcagttacatctgtaataatagttggatataaagattcatatcctgagaactttccgccattctcatattttgctttgataatctggtaagcttttactgtaacgccagtttcttctacgccacttactgtaattgttcctttgtcggatgctgttcctgttgctgcatttccttcggtttttccattcgctgcaaatgtcggaatactcatagcgagtaccattaccattgccaataccattgataacatttttttaagtttactcatactctctctccttttctttccaggatttcccttacttaattattagtttctcttgttacttggtttcccctttacttttgcgatttggaagtcgctgaaaccataatctcattttgttatttattcagcacctccttggatttgtttttatataatattagtgccgcagccatcataagcaatgcgcctccaatcgtatatcgatagataccagaaccgccggtacttggaagttcgtataccacctgattcttgattgttaatacgttcttctcatctgtggttaaaaaccacatattcggtttctgagtaagtggattacctgccatatcggttaaaataacctcacccttttcctgcttgaagtaaatcttattgcctaaaggcaagtaacctgttggagcttttgtttcttcaagataatattctcccggttctaaccctttgagttctatctcatttgctccatttttaacggttaaaacatctcccaatttttgataagcgttaccagctttcttatacagctggaattctgctccatctaattttaagtctgtattattttctgagactttcatcaaatcaaggtctgctgtttcttcctgataggtattcgtaagttctacttctgcatcctgaccatctgtcactgtataattacctgttgcaaacattgcccattgttttgatttatcaaagtgcataatgttttcaccgtcgtaagtaacctctccgtctcggaatgtcaacgtggaactaattttatccactccactaaagaaataacatttctctaaaactgcttttggtgaaaaattcattccatcttttctggaaatcaaatcaacaattgccattcttgctttgatacttgccggctgtctggtccaaacaaaatatccttcatttgaggttaattttgcaacgattaaatttacttctccaactggataatcccgtgcggaacatgttgttgtttttattgttgaagtatattcaattgtcgcctgcttaactgtcacatctgcactgtctccatttgaaccattaattgatggcgttacctgatatccatcttttttataattagactcgacaactctgtaagttcctgttgaacaattttccaatttccaggtgtaaacccaggttgtatctttccctgtcagattctcgtccagcttatctgcatccattgtaagcgttcttgtatcacttccatttgttacggttatctgatacgcaggatttgcttttgccagttctctgatctgcgcttttgttaaaccattaaatctcttagtcacttcaataaatggagcatccggctcatccagttcttttattttgtttgcaattgttacttgagcatcttttttcaattctatttttccatctgcaactctttgctcttctactttttcgtctgctgttttaatgtccgacttttcacaattgctgacagatttttcaggctctaaatatcttgttttatccagattcacttcttctaccagaaaacttgtttcagaaagaatctgtgtaacaatcactgtataacctgccggtattccagtaacaactccatctgcatctgttttgccacaaacaacactcttactgccatttgattccaattctccatctttgtagtaataataatttccttccccatctttaagatagtaatcaccctttgtataaggcactaacgtttgattagcctcattattagatagttgaatcttaaatgaaaaggtatcgtttgttacctgtccatctctcatctgctttgtaatccgaagttcacggctgttatatgcagaacaattatttacacaaactactgtcggtctttcttctactgtctttttatctgttttaacatccgaaatcgttccactaagctgtgcattttcatcaaatgctttatactcaacgccattaataataaccttatcatattgctgggcattcactccaacctctattacataatactttcggttagctttcagtccgctaaatattgctgactcatatggttttagataaaatacctttttatatgtcgtatcattaaatgttacatcctggaacttaactttttctgttgaatctttatacgttgcactatctaataattcatactcgtcatcgtaatacgtttcatttccttttggatctgttgatttaattttctgtgcatagacctggaaagcaaattttacattgctgtatttttctttatctgtgttttccagttcttttctaacttccacctgaccttccggaataacctgaagattaaatttcatgtgaagattagatgcacctgcaccacgttccatgtagaacattttaaaggaatggagagtataatctttcaatgtgtcgtcatcaaaacatgcttctatttctttatcactggttttactcgtccacttatttccattcggaagctttttagcatcttggaaaagttttttaatcgttgtcttatatttttttggtgtacctcctttaatacaatcataccagcttacctctcctgtattaaaattaatactgccggagtgagcatcatgaacaccaccaatatcaagcaccaagacgtcgtcgatataaatccataagtcatcatccccattgaattcatatatcatcgggtctttttgaccactaacctgtttagaagctattttaccatcttttggctgaaaaaaacttgcgcccatatacatcccaaagtaataattatttccatttgttttataaagtgtttttccttttgaactatctgaatctgataaaacactaccattttcatcatattcatttttattagttgatacgttttgactattaattgtgttatacggcataaagtttccacgtttataataatactgattttcattacttggtgtacccagtgcattgtatacggtaaaatttgtattgtttcctaaatatgcataattctgaaaactactgtattcataataacctgtgctgttatagatatcttttcggaataaatgatctacttccgttcctccgctaaaaagactcgccaaactttcattagcagttccgggaattgctgaacccgtagatttctgacctgtaatacaggtattcactcctgttgtaattggatagccatctgtgcctaacacattttttaaaagaccttttttaatacttcctgactgattgttattattctgccagtttccattattccacgttccggcacaatagcctcctcctaaatctatccaggtactactatccaaagcttttatcttatatttgttagaatccttaccttccatatcaatcattcgcattgtaatacccgcttgagcatgactgactgtttcaactttatccaacccggattctttatcggaagcataccaggctagcacataattagaaaaactatctgttataaattctgcctttgtaacttttgtttcacttgttgtctgtatatttgcttctttcttttcatcagccaccatatcgacaacccgttttactgctccattcttatcttcttcaagatgaataactgtaacatcaagatctgatttttctgtatcaacatcttccggtgatactccttttttatacttcatcgtaaccttgacatttccatccggctcaattttatttccatctttatctgtgagtgtaatatcataagccagaaatcctgctatagagtactcttcgtcctctgccttctgatttaatttttcctctacctcagtatattctgtcgtatctttttgaaccgatgttacacttaaggttgttccttctggaattgcaccttctttttcctctgtaatattaattgttacctcttcatcttcgtatgtaagtataggtttggtttcttttatttcagtttcagcttttgctgtctcttctgtttttgtctcttcttttgcctcttcttttacttcctctttaatttcttctttcggctcttcaactatcctttcttctgcctcagccgtttcttttacataacatccataaactccggacttttcagcttttaatagcaccttattaactgcatttttttcctgattcaagctaacatcggaatagatatattcatcaatattatctatactctttccttccgctttcagtgcttcctctaagtctgtttttgatgttatatttaaaatttcatcggattcttttttattttcttcggttgctttgtccagatagaaaacatttatttttttcgtatctgctgtctgaatattggtattgttttcttcaattgtaatggtaaccggtttgtttggattctgattttcaccgtttactttaaaattaatttcatagaactgataatttccaagcttttctgtttccggaagattttttccgattaacgcttttacatgttcctgagtttcggcatccagttcttttacttccatcacaatgtctgaggttaatgcttcaaatgcaccttccggaagatttgcgataacgcttgtaagcacgtttccgttttcatcctgaaattcatgtctgatttcagttgcttcagactgtacaccttctttagaaacagtttcttcagaaacggtctcttctgcaactgcttctgtttcttttttcacttccggtattgtttctttcgatgtacttagctcttcgttaattccttctgcctgcgtctctcccgttgtcgttgtttctgtactttgtgtttcaggttcctgacttgccatggattcagaagaggttccacctatcagaccaccttctgccatagtagacatgctggttgtcagcatcagaaccatgcaaagcacaaacgccagaatttttttacttttctcacttttcatggcttcctccttctactatctcatcctcgtcttcagttactgcaccatctattaacttcaataattctaaggcactgcgaaaatattgttcctgttttgtttctgcccataatacacttccctgccaggttgagttctgacattcattaatctttacgataaatgttttggtctgttttttcttagccacaatatcttcgcctcctttcttttctcaaattaaatcattaaatattctatgttttttactatgcggttattatagcgtattgcccattacaaaaagcattacaccttatttttttattaaatttttccacaaaaaaacattaccatacatctgctggtaatgttttttctttcgtaccttaaaaacttgaagtattgttgataattttaactaaatccagtgcactggaaaactcataactttcttctgattccattaaaacaatttcgccctgccaggttgcattctgtcgatactgaacgcacaccagaaatgttccctttgtgcctttttgttctaatacagttttaggttcaacaactttaggaattgtttctctttgctgtagagctttttctctcaaaaaagacctgctctttgttgatgcttccggaaaatgaagtttatcatacagtttttccatttcatccaaaagctcaacgacatttttaaaattcgtcgcctcttttttataacaatgataaagacgtcctttcatttcttcctgcgcaatttcgtctacacatatatttacaagattaggtgccgcctttattcgtcctatattttgtccgcttctcatattttcatacaccacacctttacctcttaaccttcaaaggtcattctgcccgttgaaggtaatctttgattttttctgttcaacatccacaatagatgatacataatattctaaatactgtgcccatgttttatgctcacggctgaaatattttgtaattctatcataaatctgaggacaattttcctgttttgtccctaccagtaaaatcaaaaactgattcgggctgtatctggtataagagtcgcctttacgcagtgaacatttaattgtatgatccaactcttcagataacacctttaaacgctctttgttttctaatgggcgtccttttccgtctgttaacgttaccaacatcaaataaacagactgaccatttctttcgataatacgggtcaccagacgataggtatcacggaaacttggcagactacagtaatacgcacctttttcttcatatttttcttttaaaccgccacgaatatcctttaatacctgcggtttgtaactgacccgttcgctcatttctttgaactgctccatcattttttcagatggactgatacccaattctgcaaagaaaaattttgccgtatcttcataaagctgaatggcttctttgtatcgattcatagcaaccagcgcttccatcatcacagactgccattcatcaaatggataaatttcagacgctgatttagaaagttccaacacactttggtactctttctgtgcctttttatactcacatacttctttcagtgctttttcataaacttttttatattctacactttcaagcagtgcccagtcctctcccgaaagttccggaagaaattctcctttataaatccggcaggcttttgtcagcagttccatttttgtccggatatcctctgtctcttctgacttttcaatgagcttttttaattctaaggcatccacctcaacttccatcggactgttccacttatagactccctttttaatttgtatgtaatcatactcaggcagtcctgcatctacaagcatttttttcagtctgtgtgaagttacccttaaattgtttgccatatctgccagttcatctctgctataaagataatctagcaaacgagttctttgaattcctgtttcttttgtatacaatagtatctgaaacagctgcaatgctttcgttgacgttgttctcttaaatgcaatgtctttttctccccagctcacagagaaacgtcctaacatcgtcacctttaaaaccggtaattccttactcatccttatacaccccttttcataggatttctccctgtttgtcaaactacagccactccctaatgccgtacttttgcagccatatcttaaatacaaaatatagttactaaactaagcgagtattcgcacttccctttcctgcttacttgctttcgttaatctctttatacttaagatatcctagcttaattctaactttttgccattcttttgtcaacaaaatagattgtcagattctgtcgaaattggaacaaaaaatcttactctgagtttttttcttaattgtaaactataaatgagcaagttcgtgattttgcatttctcatcattttttgaccacaaatttacgacatttacgacaaatctgacaccactttacaataccagacaacaaagacgcaacccacatttctgtgacttacgcctttctctactcatattttcatcatccagacttttcactctgcttctgataatttactgatggcaacagttcttgcagatggcattactttccacagcactccacaatggctttttccacattttctatctgaaatggttttgccagatgtgcggtcatgccggctgcgagacatttttttgcatcttcctcaaatgcatttgcagtcattgcaatgatcggaattgtttttgcatctgccctctccatagcacgaatcgcctttgttgctgcaataccatccataacaggcatcatgacatccatcaatatggcatcaaaggttcccggaggattattttcgaagcactccactgcctgtctgccattttttgcaactgtaaccttcgcaccgtcatctgtcagcagcatttctacgatttctgcattaagatcattatcctcggctaccagcagatgcagtccacaaatatcatatttctctacaatttcctcatcctttttctgtttctctgcaatctcaaagggaatggtaacgacaaacacagatccaacttcctcctgacttgtcacttcaatacttccattcatctgctcaatcaatcccttagtgatcgccatccccagaccggttccctggtaaacactacgggcatctgttttttcctgtgagaatggatcaaaaatgcgactcaggaactctgcactcatccctatacctgtatcagaaatcgtccatctgtatgtacaaatcccatcatgtacatctgccgcctccattacggtagtaatctttcctcccggccggttatacttaatacagtttccatagatattcaaaaaaatctggcgaagatgcagtgagcttccatagacataaggatagggaatatcctccttatttttctcataaatccactgaatattctcatctgctgccttgtgagtgataacgctctcaatctcatagaccagatctttgagacagatatattcatgagccagaacaatatggccttcctctattttactcatctgccgaacatcattgataagggaaagcaaataatctgctgctatcttcatctttttatgattttcctgtatcagtgccttatcctcaaaatggttctcatcaatctttaacagaccaataataccattcaaaggtgtcctgatatcatggctcatacgactgaggaaattcgtttttgccctgctctcggcacgcatctcattgaatgcagcctgaaggcgcgcctgttcctgttcatcacgttcatgtctctgtgtggtatcctgcagcagaatgatcgcatagatcatagggatctcagcaaggatttctgtatcaaacactaccatactggtcataagcactgttttctgtacccatcggatacttccatcgtcttcgcagacacaatattctacagatatatgtgtttctccgttctcaaacctcttacgaagcttttcacaattatctgtcatgcagtaaccggcaattgtttcctgagtgacttttttctcatattcccagcagtaatcctgataagagtgcggaagcgaataatccataaaaagttcccggctcttctgctcttttccattcagtacgatccttctttccagaacatcctttgtcagatttactgtatagatcacatctgacaattccagaagcgcatccacatagctgtcattttccaagatagactgtttcaactgttcataataaagctgcaactgctcttttgcacctgtctgaccttcagaagtctttcggatagtttcaaatgccaggagaaaatgatgcagctttttatcctcatcccagtccaccggaatcaacgtcagacggttatatgccccctgttttccggtattatactcatattccagcacatcttccttcgtatgcatcttcctttgaagctcagaaatctgcagcccttcgcagatatctacctgacaggaactttcaacatgttcctctatgatctgttccactgctccggaatatgcaccgtcagaagccaggaaaaaattctcgctggaacgaatcgcccgataggtatccatcctggcatcacagtacaggcagtctgagaagttactgccatgctgattaagcagctttaacagctgatatccctgattcctttctgctgtagcctcttcccgtttcacatgatttttattgatatacatgtttttgtctgcgcagttaaacagttctctcattgtactcccgggaaaatcaccggccaatgcaaatcccaccgcataacttaagggtgtatccggatacactctggattcctctgtcatatctctgcgcaccttttcaagacactgtgtcatttgttccctgtccaatccatgggtaactgcaagaaattcatctccacctgctcttcccacaaactgctcagccggcatggaatctcgcagacagatagcaaatctacggatataggcatcaccggcttcatgtcctctgctgtcattaatacgccggagattattaagatcaaaactgcatacaccgatatctgcatccggttcttcctcattcagcaattcttcacatttatttttgttcggaagtcccgtcgcatcatccagatatacctttcgctgcagcaaacggttcattgcagcatattgtattgctttgataaactcatatccgatcaatagcatcaatacaacaatatctgccgtgatatatttttcaagcaatgataaggatgtggcttttttctgcgaatatttttcggccagacctgttgcttcatcacagattacaaagaagtcctcacttctggatataatatctgttttttcatatccttcagaccgccccaaacagatttcgttatacaggtcagaaaagccttcgtccagttcctgcattttattctgaaaatccttatcattcaaatataccagattcagtttggtatttccatcgcgcagaccaccaatgaaagaccttacctcctggatcattgcatcgtcctgttccccggcaacctccagcttgatgatcctctgtgtctctccacgaactaaaccagtataatttacaatacgggccgttccctgaatatcagaaacaattctcatcattataataataaggatagccagaataactgccagaacaccaatactgacctgaataatagtggatttctttttcttattctttacttcagacatgctcctcccccttcttgttctattctgtaaaaaatgacctgaatgaaccgatatcccagatatcctgatatagcgcctgccagagctccgccaagaacatctgtgggataatgcacatatcttttctcccattttttcagcatatgcattattttaccctactttctcctgtatgcctactcaaattttaatgtatttactataaatgagcaagttcgtgattttacataaaaagaaagacaccttaaatcgttcatgttgtataatgaaagtgacgaaacacacattgcaacattcacgaaagaaggtgcctctcgcaaattcttaaaatataaaacaaaaatacacccctgtcttacccttacacaggagcgtattctacatttctatttttttatctcctctgtctcgataataaaccgtacacttccgctctgcccttcgtaaatgcctccaaagttctggtactcggcatctacttttttaagacctcgtatctttgttgtcaaatttgtcaggtcatcacctgcaaggtcggttaatttctgaatggcttctttatcaaactctgcaaatccttcatctaaagctttcatcccatctatcaatgcctgataaccactgtcgagagcacttccggcactgcttaactggtctgttccttcacttaaactctgaccgcccacatatagctgaccgattccatctgaaaatgcactgattccggtgtttaactgactgcttcctttggcaagctgctcggctgcattttgaatcgtctccattccttcctgcaaggtctgcatctgttccggaagtccttcaagcaattccgctgcttttccaagtgcctgcatctgagcctgcatatccgtcaaaatcgcaggaagggcactggtatccacgcttaaatccggaatatcaagcgccggaattgaaagtaagatctgcaccgcctcttccgttttttctctggcttcttttgtcagctcggtatctttatcgttttcctttaactggttttccagactgctctttaatccctcttttaaaatttcctgttcttcttcacttaaagaagtttcctgcatcgtctcattaagagctgcctctactgctgaatctatctgtgcttccctctgcgcctttgcatcattttcaattgcatcccagtcaatcgctcccaatgtattttttacagcctcaacatcgttttgaaccgttgtctgataagtcactgcctctgtcacaaagttttcaaccgtttgaagctgagtctgtaattgggtcagggctgtatttaatttctggtcatctgcaactaatgcgaccattgcattttctactccgctaaaatcaaccccactctgaccggaagcatttccgaatgaaatcgctgacaagctgtttgaaaattggcacaatccgtctgttaatgcctgagctccgcttccaagcgccgtcttgttttcatttaatacctgcattccactctttaagtcatccactccttcttttaaagagtcaactccgcttagatactgcttcatatactcatcatagattttcatcccatctaaaagcttgccactgccgtcttttaattttcctgaagcctcttgaattttatccatgttatcggaagtttcatccaaatcatcgagattctcttcatctaaatcactcagcaatcctgatgaaagcacggtcgctgtaaaatccagttcaaaatccgttacatctgctgtcacttccacatattccggaagctcaatatctttcgtcagctcagaatcggagagattcagattttcggaaagtccggggcaggcatagccaataatcaaattctgtccatccaatgaaataacttttccattttttacttcgatatttgttgcattatcctctgataaaagcagggcagaaatcgctgcaaacggaacaggaagttccactttttttccatttacattcgtctcttctttggtatgattttcataatcaaaacgaatcttaagtgagccgctttttcctgccagctcttttggactgatttctttatcatccagaaaatagctgatttgaactgttaccggaagctgttcactgctctttccttcatattcaatgttttctccctgattgtcccagagaattgttccatccgattgtctggtatattcttcgtccccttttatatttttgatatcggtcagattcgaataatcctgaatcttcttctcatttttattttttaaaactgtatttacggtaatctcatttactgttccgtccgcatctgcctttgcatataccgtttctgttttatctttttctccatcggactgcttctcactgctttgttcttttgtatcattatccttttgagactttgtttccccctgtgtatttccagaggttttatccacattttccttatcggaagagttatccacactgcaggcagtcagtccaagaaccacagccgttccgattccaagagattttttccacaatgcatttcctattttcttttccactttttctcccacctttcactctacatttttcaaggcttcttccatcggaatctttcgcactttccgatattcgatgactgcaactactgcgtaggttaaaattccgattgcaaacatttccggaaacagtgtcggacttacataaaatggaatccatccgctcatacttgtcatcatcatctgataaaaaatgatttccatcaaacttttttccagcggaagcgtgataatcagaagcagtgccgttacaatcgaagttggtataatgtaaagtctcgcaatctctgcattgctgtaacctaaaatttttgccattgaaatcgactgcgcatttttctcaatgacaatcttagaaagcagatagatgacaaccataaagatgacaatcgcaaaaccatccaccatatacatcatgctgcccattgatacagtaagctgtcttgaaatcttcgttaaactttccaaatcaatcacagacgaaatatatttttcatcaatatctgtaatctcactgtctgataaatatccgctgaaataatcatttcccaaatcaaaggttcggttcaattgttcgattggcataaatacgcataaaccgccctcataatcataaattccgcctaccgtaaattcatactgtgtatcttcatagctttctcttaatgttatcacatcgccttttttcactttatacttatcagagtacgctttggaaaccagcacttcgtctccatctgtatcttcaagtggaatgtaacagctgtccgactttactccatagagcataatttcatcggttttatactcactatccaaagtctttaaagaatacgcactaaatttttctgcatcttcattgtccgtctgaacctgatactcaaaatacattaaattcatcaggctttctaatttatgttcttcattcatcgcatttaacggtatatttaaaatatactgataattgcacaacagattcttttcgatttccgtttgataatgatttaagatctgcggaagcatcaacccaaacatcaaaagcaggtttgcaaatagaattccgactgtaagcacaacataattgctgacattctggaaaatcacacgaagccggaatcttgagaaaaatggaatcctggcactcaacggtaatgtatatttttgttttcttttctttaaatcccttcttaaaaatttgagaggggacaacgataatgttctttttaataggaagaaattaatcactgccatcaaaaaaaccggtacaattgtcgtcatcacaaaggcttcaccgttccataatgtcacataagtcggcagactgtagcttccataatacatgcctgcgcagacatttttcagaaccgtataacctaaaatatttccgatcaccgctcccgcaaatgtaaccagcatcggtgcagtcatatagtgaagaatcagttcccgtctggtataacccgaagcccttaatgttccgattactgtagactctttatgtatcgtattactgattgtaattccaaatacaaaagcaagaattgcaattacaatataaagcaggataatcatcatcatacggtcactgcccatatcttcaccggtaaattgaatcgcctgattactgtaacgtggaacaaatgtttcaaggctgacttcactatttaagactttcataaaatcttctgccacatttttttcttccgtctcaccttttggttctgttccatatttccaggaataattacaaatcatgttgtccgtactaaaagaatcaaacgcctcctcagttacaattccgacaccaaattttaccgcatcaaacattgaatcattattgtccgaaaacagacagctataatctgaaagcgccacaagccctgtaattttccactctcttccactttcctcttcggtaatgatatctcctacagacagttcattgttatccgcatacatacggtcaattgcgatttcatctgctgattttggaaattctcctttcatcaggcagacacaattaacttcttcacgatttttaaaaattcgcatcgtacttccatttgtcagcaccggctctgcataaaaattttcatacaatgtcacatctgactttgctatttctttctgctgtgcacggttcactttttcttttaccgtgaaattcccatcttcaatattatatttctcaaaactttcattgtaagcagtcagcatacttccatctgctacaagaaaaccagatacaaatccaataatgctcattaacagaaagaaaataacaaaatatttccctgcctcacctttcagctcacgaaacagcctctttcttaaaggatttttcattttttcctgtcactcccctatttcccatttaccactctaaatcctgggcacttacacgtgcttcattcacataattcttccgaatcattccatctcgcagacgcaccacacgatccgccatatctttgatggcatcgttatgcgttaccatgataattgtattgccatatttttgatttacggtctcaattaattttaagatttcttttgaagttttataatcaagcgcgcctgtcggttcatcacaaagcaaaatatccggatttttaataattgcacgcccaatggcagtacgctgctgctggccacctgaaagctggttcggcagttttttgcggtgttcatacaatcctaatgtacgcagaagttcttccatctcaagcggtttgtcacttaaatacgccccgacctcaatgttttcctgaactgtcaggtttggaattaagttatacatctggaaaatataacccagatgttttcttctgtataatgtcagacgcttttcattcatgtttgacattttttccccatcaatgcagatatctccactgtctgccccgtcgattcccccgatgatatttaataatgtagattttcccgaacccgacggtccaagtaaaacacaaaactctcctctgttgatttccagattaattccctttaagacctcaacaaaactgtccccctgcccaaaggatttttttatatcacgaatctcaagaaacatggtttgttttctctcccttatattagtttatactaaccattgtagcaccagatggttttttcataaataaaaaagaatgttttaaattagtctttgtcactctatattttttctgctataatgtgcgtagacaaaaaattatctattattcttaattttatggagggctttaaaatgacagtatttaatacaaaaggtgtctgttctcgttctattgaaattgaactcgacggtgacactgtaaaatcagtaaaattcaatggcggatgcaatggaaacactcagggtgttgctgctttggtaaaaggaatgaaagtagatgaagcaatctcccgcttaaaaggaattgactgcggtggccgtggcacatcctgccctgaccagcttgctaaagcattagaacaaatgaaaacccagaatgcataaagcatagaaaaagagtggttctgaatccttttttcagaatcactctttttttctaccatctcttttcaactgccggacagtgatttttcttcatcactgcccgcatttccacgaaacacccacagattcgacacattccactcagcagattatcacactccttacattttgcaaggcggttttgatactcctcatcttctacttttaagtctttgtctatctgtgcgatgtactttcgcaaatctgtaaaatattcgttttcatccatatcctgcagaagacattttctacagatttttctatacgatggctctttctctatctgtcccatttgtcacaaagcgaattaatctggtctgccaatcttgcaagatccttatttgctccgccctcattatgccggataactgcaagcagtctgtgaccggcagccacaagtctcgcataaacaccagatgccttgcgtgctttcgctttctcctttgcatgttctattatgataccttcggtctctttctccagcacattattcgccaaatcaaagaccgttccactaaacggagcgtaggtatcatagcccagttcatttttcagccgttctgcaaagagtgtacagacggtatcttctccatgtgtcacaaacacacgctgtggtttttctttaaatgcagatgcccagcgcatcaatccttcattgtctgcatgaccgctgattcccgaaagtcttacaatctctgctgatacatgaatttcttcaccaaacagtcttacatcctttgcaccctccaaaagtgcacgaccaagcgttccaactgcctgatatccaacaaacacaatcgtagaattttcacgccacagattatgttttaaatgatgtttgattcgaccggcatcacacataccacttgcagaaagaatgactttataatgttcatcaaagttaatggcgcgggattcatcacttgtaatcgaaagcttcagccccggaaatgcaatcgggttaattccctgattcaaaagttccattgcctcttcatcatagcagtctacataatgctctttaaaaatattggttgcctgcacagcaagcgggctatcgacatacacatcaaaatccggaaattccggaagcaggttatctgccttaattttacgaagaaaatacagcatttcctgcgttctgccgactgcaaatgaaggaacaacaacatttccatgtcgtttaaaggttcgtcttaagatatcaaccaattcctgcacatagtccggacgttctccatggcttctgtcaccataagtagattccatgaccacataatccgcagactcaaggtattcaggatctttaatcaatggctggtctgtatttccgatatcaccggaaaatacaatcttcttctcaacaccatcttccgtaatccaaatctcaatacttgaagaacctaataaatgtcctgcgtccacaaaacgaactttaattccatctgcaatctgaattattttatgataatcacacggaacaaactgctgaattacattcaaagcatcttccatcgtatacgccggaacaaactccggctgcccatttcttcttgccttacggtttcgccactctgcctcaaaggtctgaatgtgagcactatcacgaagcatgatatcacacaaatcgcaggttgcagcggttgcataaatcggaccgcgaaatcctcttgcataagccagaggaaaatttccggaatggtcaatatgcgcatgcgtcagcaaggcaaaatccacatccgacatcggaaccggcacatcctggttctcatactggtcaggaccctgttccataccacagtctacgagaaatctcttgcccgcagcttctaaaaagtaacagctacctgtaacttcatgagtcgcacctataaatgtcaacttcataaaaaaaccccctttgcggttttaattcaagtactttcaagatagtactattataccgcaaataggggtcttttgatagttttttcagattattttataaaagtttatgattttttcaaaaacagggttttaaacttttttacttaaagatacttaaaaatacaaattgtttttaggataaaaatacttattcttttcattcacagccggcaattcacggactatgaccttatttattggtcattaagataggagattcttgccgagtttaaaattgaataaaaaaattaatcaatccagataccgttggtgataggtacttgagattcagaattacccgatttttgtgctacacacgcagctttcacacgataataataaccaccagctactttcacattgtaactacgagacatagatgctgcattagtagcagtatcaccataagtaccataattcacccagccaccatcatactgctgcaatgtcaatttcacaattaatttatcacaggttttataagcaagagttgctccataaatattgaccgtacgatttccaatatttgtaatttttgcaattccctggtctaatagacttcctcttgcaacattctgccaaatagcttctgctgattcttcattcgttaaaatagaaccatctacttcttttcctaaatcttctaatccatctgctgatactgaaatagaagacacggttaagaatacagataataccaacatagctactattgatttttttaattttctaattactgatttcaaatgaagtctcctttccggattaatatacaatatctttgacgatttttctcatctcttcttctgtaatttttccagaaattcgataatatgaatttttatattcccattgaactaaataggttgaattttcactttcaccgttctgtattttccataattctggttctatatttgacatttcgcactctgcaattcccaagcagactccctcatcatttcgataaagtccactagaatcactataatttgcctgtataataaaatacatataatcaacaccattataatatcttatatatacagactgcgcagtttcatcaatctcataagaatcaaaattcattcgattcggcaaataaaaaaaatgaggaacttccatttgaagtttttcctctatctcacttctagctttctcttctgttctgtcactaatcaatctatcttgactattttctatttctgtatttttctcatcccccaacacttcattcgctttatccataacataactcctgcctccttgtgtgctcatactcacaccaaacaatccaaagcaggttatcacagctgcggcggtcatgccgaggaattttttgcttatgcggtgattaaagaatttaaccacttttgtattctgattttcttttgtgttttcttctgtagatttggtttcatcttcaaggtgttttgtgttttcttcttcgagcagcccctcatcccgagcttcaactaccagcttttgaaacagttcttccggtggctcaaaatcatcgaacctgtcatctgtttccagacgttttaccagctcatctgcttcttttcggaactgttcttctgcccaggtactgctttttgcgctgttttcttcgtttttattcatgaatttcctatcttttcttgacttttcacaacgactgtatcatattatctaatagacgctgcaatgtccgtcttattgaatgttgtacatcgaaacattgatttttgatttatcaggaggttccaatgaaacatattgtgctcaccggtggcggcactgccggacatgttacaccaaatattgctatgattccgagactgaaagaactcggttacaagatttcttacatcggttcttaccagggtatggaaagaaaactgattgaagaaatggggattccttattacggaatctcttctggcaaactacgacgttactttgatgtcaaaaactttactgaccctttcagggttttaaaaggttttcatgaagcgaaaaaactcatgaagcagttgaaacctgatgttgttttttctaagggtggtttcgttaccgttcctgttgttattgctgcaggacgtcgaaaaatccctacttttatccatgaatctgatatgacacctggactggcaaataaactttccattccatttgccactaaagtgtgctgtaatttccctgaaactgtctctgaacttccggccaacaaagccatacttaccggtacccctatccgccaggaattattaagcggaaatccccaaaaagcacttgcctttacaggtctttccagtgagaaaccggtcattatggtcatcggaggaagtctcggtgccgttgcagtcaacaatgcagtacgtgccattctgcctgaacttttaaaagacttccaggtcattcatctttgcggtaaaggtaaactggactcttctttaaccgataccaaaggttatgttcagtacgaatatatcaaagatgagcttgctgacctttttgcactggctgacatcgtcatttccagagcaggggcaaacgcaatctgtgaaatcagtgcactgaaaaaaccaaatctgctgattccgctttccgcacgtgcaagccgtggagaccagattctcaacgcccgctcttttgaaaagcttggttacagcatggtacttgaagaggaggaaattactaaccagaaactgttagaatccatccagactctttatcagaaccgcgattcgtatattcaagcgatggacaaaagcaaacaaacggattctattgaacagattgtccagttatttgaacaggcagtcaacaaataattatttctcctgtgccggcatttggcacaggaattttttttggaaatctatccacaagtattgttctgccggattcactggattctgtttttatatatcctcgtatttgtctccatacgttttttctatccacttgttcatcctatgttttttaactcttaagttttctatagtcagacccagagcggccgccatttctgcatccgttgcctgttcgtaaacctgcatcgtcataatttcgtgccactgagggttcctggcgtacagcctgtccataaattctgtcgtgaattcccgcttgataattgcatcgagcaggtcttctcctgttgttgcctctctatgataaattaacctttctgcgtgttccccttttccattttcacacggctgttcaagaacagtcatctcatgttttcgataactttttttgaggaaatccaacgcctttcttcgagcagttaatgccagccatcccgcatagtcttcaggacttaccttgttccatttctgtatcagcttatggaacacttcctgacagacatcctgcgaatcatcgaaatcttttaagacatcataagcggctttcattaccagtcgataatacttgtcataaacttcacgtaatttttcctctgtcatcttcacctgttaattcatctgaatcttggaaattttttcgaggatttcatttttatcctcttctgtcaatttcccaggagtccatgtcactcctacgtggtcctcattatttcttggaatcagatgaatatgaaaatggaacaccgtctgacctgcggcttctccattgttctgtacaatattatagccgtcacagcctaatacttcagtcattgcggtgatgattttttttgccagaacaattgcttttcctgcaagttcatccggaatttcatatagatttgcatagtgctccttcggtaaaatcagcgcatgacctttacttgccggtcctaaatcaagaataactctgaaatcattatcctcatatatagttgctgacggaatctctcctcctgctatcttacaaaaaatacaatctgacattttaaatctctcccttctagctgtcattgtcgaattttcaaatattttgtagaatgattttatttgctatttgcctataacggtgctacactatcaagaaaaaaagaggaggtaacaccaaatgacaaaatcatctgctacttcacagattgaaggcaaaaataaaacaattgattacaaaaaactttatcaggaacaagcgaaaaaacatcagctgatgctttctcagatttcccacgaaatccgtaatcctgttacacttatcaacagttttcttcagattctggaaaaacagcatcctgatttatcagaagaccaaaactggattaaaatcctggaaaatatggattttctcagaggtctgcttggtgagctttccagttacaataattctctcagactgaaccttgaatcaaccaacgtctatgcattatttgcaaatgtaattgcatccattaatccaagtctggaaaagaaaaacgtttctattgcttttaataaattgtctccaatccctttattgtatgttgaccacaccaaacttcagcaagtgtttcacaatctgcttcgcaatgcatttgaagcggttaaagagggtggtcatatcgtctgttcaattgaatcagacggtacaggtgtgacatttaaggttaccgacgacggatgcggtatttctcctgaataccagaactctatctttgaaccatttgtcacttataaaccggatggcagtggtctgggacttgcaatttcaaagcggattgccgaagcccataagggaagtcttgaattcacctcaagtcctgaaaaaggaactacattcatcctgaagattccgattctgtgaaagcagaatcgttgaaatctttgattattctaagttactctgattattctaattactcttcattctgattagaattttttaagtcctctgccatttttttgtcctctgtaaattaatactgcaaggacaaatccacacaagaatccgccaaaatgtgcggcattgtcaactcctgtgcttgttactccatgatataaagttaaagctgccaaaaataacagcttctttgtcgtaaaattttccagtctgcctttatttctgattactacataaatcaatgcacccactacggcaaaaattgcaccggatgccccggcagacacgacgttttctcctattcgcatctctgacagataagaaatcagactggctcccattcctcctgatatgtaaatgaacaggtatcgtacccttcctaccgcccgttccagacaatctcccagaaagaataaaaccagcatgttgttgcccaggtgcgtcagaccaaaatgcaaaaacatacaggtaaaaaagcgataatattcatgcccctcctgaatcaatggtgtgtatgccgcaccccattgaaccagatgttttccatcaagtgaagaacctgtcaactctgtcaaaaagaacactacaatattaatcaaaataatcattgtattaaccggcacttcttttcttccctttaaaaattgaaggatatcggggtcaattttctgtactatcttttgcttttgcatcttattttccacctttgcaaggtataaatttgctttttttcactctttttatactcctcccctcatttttttcaatcccctcttggtttatgcccattataccatattttccctgttttgtgcgcttttttcatcgccaaaaaacgacacctttcgccatttttttgaaaaggtgtcgtttttataaataatagcttgttttatttttcaagaattttctttaaatcttcttccggtgtgccggtcggtgagatctggaaattttccaccagatagtttaatacgttttcagaaacaaaagacggaagtgtcggtccaaggtaaatattcttgattccaaggtgtaacagtgtcagaaggatgctgactgctttctgttcataccaggataataccagtgtcaacggcagttcattgacaccacattcaaatgcttccgcaagagccagtgccactttaactgcgccaaatgcatcgttgcactgtcccatatccataattcttggaaggccttcgattgttccaaggtctaagtcattaaagcggtattttccgcaggcaagagtcagaataatagaatcttttggagcttcttttacgaaatccgtataataatttcttccctgacgtgcaccgtcacatccgcctactaagaagaaatggctgatttttccggcttttacagcctcaatcacctgtggagcagcacctaaaattgtatgatgtccaaatccggttgtcagttttgttccaccattgattccggcaaactgcttatcctcagaaaatccaccaagttcaatcgctttttcaatcactgcgccaaaatctttttcttctccatctacatgctgcatgcctggataggctaccacacctgttgtaaatacacggtctgcataactttcttttggcggcataatacagtttgtggtaaataaaatcggtgccggaagattagcaaattctttctgctgattctgccatgctgttccaaaattaccttttaaatggctgtatttgcgaagttccggatacgcatgtgccggaagcatttctccatgtgtatagatgttaatgcctttgccttcggtctgttctaagagcatctttaaatcttttaaatcatgaccggaaattacgataaatggtcctttttctacttttaaagaaacttctgccggtgccggaattccataagtttcggtgtttgctttatccaaaagttccatgcatttaaaattcactgcaccggtctccattacgataccaagcagattttccatggtgcggtcctgtcctaaagctgacatacctttgtagaagaaacggttcacttcttcatcattatagccaagcaccattgcatgataagcataagccgcaatcccacgaagtccgaataataataatgatttcaaggatttgatatcctcatccggctctctccatactttttccatttcatagatttccatgcgtccacatggagcctgacaagctgaacatcctgatgcgtaaacctctttttctttcagggctgtttcgattaatttttccaacgcttcatcatcaaagtttacattggtaagagttgcaaacaatccttcaatcataatacgatttgtcttttcagatacattctgttctccgactgcttctgcaagcgcaaccagacttccggttaatttgtcctgaaggagtgccgttttactgctctttccacagactcctcttgctcctgtacatccactgcatcctgctctctgctcacactggtagcagaacatttcttctgttttttctattttgctcatcttctattctcctttagctgtttcacttattttttcaaatttcttgtttctatggttagaatatactataattaaaataattattctgttgtacttccaacaaattcaaggagtttatttatggaaaaaaataataatttaaatgaagcttttttagaagtgcttgcggagtctccattgtttcgtgaaatcgaaaagaaagaacttcgtgccatgttagtctgtcttggcggtcagataaaagaatataaaaaagggacttctatcttccgctggggcgataaaatctcaaaaatcggatttgttttaaagggaaatgttcacgtgcttcgggaaacgtactggggaaaggaatctctgcttggacggattggtcctggtgatttgtttggagaagtctatgcctgtctgccggatttggaatttgacggaacagttgtcgcccagactgactgcagtattttatttcttaatttaaaccgcacgattgctacctgttcctccgcctgccattttcacacgcagatgatttctaatctgttgcagattcttgcacagaaaaacattgcattttcaagaaaactcgactgcctgagccaccataccatccgtgcacgacttattgaatatttctcaaaacaggcacagatttgcggaaattcttctttttcgattccattaaaccggcaacagcttgcagattacttgtgcgtagaccgcagtgccatgactgtagaattgtataagctaaaagatgagggaattttggattttgacagaaataaatttacacttttagaataaaaaaaggaaccttgtcactaagattcctttttttaaacagtttttcaatttcaattctatttttaagctattgctgttttactttctttttttggtttgtaaagcggacattcgcaatccgcttcgctacttgctcatgaacgcagtcgcttcgcgatctgtcagtgggagctttcaactctcactgacagaagcatccccctcacccaccgcttagcgctctgcacacttgaagcgggggaatgcttatctgcgttcaagtaatttcttgataccctgaattgctactaatacaccaaggattaacagcagaactgcgaagataagctgtaagctgtttccaaggtctaagcctgttgtcataaatgctttgcttaattttacgatagtcatgccaagtgctgtaaatgtaacagccatcataaataccatcggtccccaaagcatgaagccctgacgttttgttttctttaagaatactgcgcaggctaccagtgccagtacggataacagctggtttgctgaaccaaacaacggccagatttctgcatatcctacttttgtcagaaggtaggcaagtaccagtgtaatgatagttgcaaaatatttgtttgtcacaaattttaagaatggactcatattctcttcatctacatcggcatcaaggaagaattcctggaaggacagacgaccaactctggctacagagtccagtgaagttaatgcaaatgcagatactgccaggttaatcaaagtaaataccaaggagtgtggcagaccgattacggaaaggaagtttgcgattgcacctgcgaaaatctgaggctgagttgtcagtccctgtgctgctgcttctccttttgcaaaagatgcaactgcgattaaggcgataactgcaagcatactttccattaacattgctccgaaggataccggaagcatatttttttcatttttaatctgtttggaagcagtaccggaagagaccagtgaatggaaaccggaaaccgcaccacaggcaattgttacaaataagattgggaacatgtactgtccgtctacgttaaagcttgtaaatgctgcaagattgcaggatggatttgctacgaacacaccaacaaccgcaccgacaatcatgaagattaacaggtagctgtttaagtaatctcgtggctgaagcagtgcccataccggagcaacactggcaatcatgatatatacaaagatgatgatgtgccatgttccaaggcttaagtacatcgggaagtttaatcccagtgcaattgctactactaataataagacagccaccgctgtattcacccatttgttaaatcttgtgtattttaagaacattccaagtccaacggcttctaagataaacaacatagaagtggttgcaactgcaccgttagctactacttttgttacttctccggcttcgtttgctgcaaatccgttaaatgttccggctacaacatcggcaaatgccgcaacaaccagaatacagaataaccagcagaataacaggaataactttttacctaattttccaatatattcttcgatgatataaccaattgtacgacctttattttttacagatgcgtacatggatgcaaaatcctgaacagctccaaagaatacaccaccaattaaaatccaaagcagcaccggaagccatccaaagattgctgcctgaatcggtccattgattggacctgcacctgcgatagatgcgaactgatgtccaaatactacgtttgtgtccgccggcacatagtcaactccatcttccatttcataagcaggagtttttgcgtttgggtcgatgccccatttgttttgaagataacggccatacaggagatatgcacctccgagtactacaatggcgattaccatcattaagattccactcatagctctttccctcttctcttaaatttattttttaccaagttttgaaaatagaaataaatttatctataaaaaaacgcccttgctatcctctcggataacaaaggcggaattttctttccgtggtaccactttgtattattgtacctatcgctaactacaatctcttaccactgtcttttttaacagtctcttctgtaacgtgaagcccacgtccctgcctactttcaaagttttcaaagcttttcaatacgtttaatctctcaaagctttcatttcagcgggatgctctagggtgatgtcacaaaacactttctaccgtttcacacctgccaacggctctctggattccagttctcttttgtgatgtatccctttcactgcatttccttttcttaatttatgttatgttttactctttttttatttaaaacacaagagtatttttcaacatattttatagtttcgtcgatttatttttgtgcaattttcagataacaccttttattttctccaatttggcaatttgatagctgttttgggatttaattccagtcatcttgttcttctgcttcctgcactttttttaatttttcttctttttgttttttattattatgactgtttcggattacaaacacaacaaccacaatcaagataagcgcagccagcgcaattaaaatttctgacaactgtcccattttagaatcagacggttccgacacgcttattgctgtctccggtgcatcacttaaatcaaacagggtattttctccctgctgatatcttttataactttcaagcgcataaagcgtctgatatcctgccaatgcatccggcgcattttcattttcttccagagaatgagccattcctccatcctctgtccgaaattgtaaaattccgtctaacaggctgttttcttcttttaagaaacgagcatcttctaatggattgatgccattactacacacggcaatcaacgtccagtctgtactttctacactttctacacccatagatggcattgctccatctgcctgctgctgactggaaagccaggaaaatccattttcaattgccgtactcactttttcctcatctttatacggagccagtgctgtgagtgccattgctgtgatatccacatcggaatctccatctgtggaaagtgaaaatcctccatcttcctgctctttttccagaatcgcatccactaatttttcacgattccagacagcatcttccggttcttcataatctttactgtctaatgcaagcagtgcccagatataaccatttgcaccctgtactccaggatcttgattttcaaacacacagtcaaaaatcccatcttctaccagattgatttcttttttatctttatctgtgccaaaagcaagggcatctcccccacaggcatttattgtcaaaatttcccggtaaaaatctgtcggattcatgtgctgttcttccactgtttttgtaatatcatcttcatacagtgtttctatctgttcctgcagtgcactaagataaccattttgattatccggctgtttcattctgctgactgtaaatgcaagccagtctcctgctgaagttcccgcactctccagtactacgccatccagaagatttttcccatcaattcccatctggtctttttcccaggaaacaattccatcctgaatggacttaatttcatccacctgatacttctcgctgtctgcctgtaccggtactgcccctcctacaaacagcactcctgtcataagcagagtaaacattgattttttcataaataagttcctctttttattttacacatactatttatcaatacttcaataaaattttctttcgtttctttgagccaattaccatgaatccaatacctgcaagcaccagaatcacaagtacaccaagcaccgcacataaaatctttactaccctgtaattttgtgctaccggtgcactgccttttgccgtgttttcttctccattctgcatgcttacaccggcatctccttcttctcctgacaaaagtgcagtttcattttctgccgaagtttcttctccatccgcattttctgcttcctctgccttcgcctcttgattctcttttgcagtctcctcgattttcttttcctgtgcctgttctccgttcttagcattacctgatttttctgctgcatttcctgatccagttgcattagagcttccattttgtttcgcatatccactctcatgcgcacctgcatgggaattagctgtttctcctgctgccgcagtattttttatctggctggtttcatcactcttgtttaagccctgataagcggattctgccttttccaaatcgctataattttccaccagtgatttttgtctatcacttaaactattgtaagcatttcgaatttgctcaagcagagaaccactctcttttgtcaccactccgatttgagaaatctttgtgctgacctgatgcgccgctaataaatcagaatagttctgataagcctcttccaacactgaataattgctgactaattcctgctgttctgcggtgagtgcattatacgcttcgattgcacgggtaatcgcgccgcctttttcaagcgtcacttctccgatatttttaattaattcgatgaccggactcgctaaaatcaggttctgatacatcgcttttgcattttgaagctgcttatagtttgtcactaatttcttctgattgtccgttaaggcatcgtataactgctgtgccttatagatggcatctttactgtttaaggtaattgttccggtcaaaatcgcggagatttcagcggaaacttcctgtgcctttaacttatcataagtctgttccgcacgattcagatattcgggatgtgccacaaggctctgctgtttttttgtgagcgtatcataagcttttcttgcctgtaaaatcgcatcttttttgtctattgtcacaggttcaagtttatttatcagctcatccactgctgatgctgcctttttatcagcttcatccacttcactttcttctaacaggcgggcatattctttttcggctgattctaacacatcataattgctgacctttgcttttaattcgtctgataattcgtcataagcacttcttgcaagattaatgtaagtcttactctctaaattgaccgttcctatctgattaatataagcttctaccgcagaaattttctcctgattttctttctgggttttctgctcatctgtctcaagacggtcaattctggatttcacatcggcaagtatctgatttactttttcaacactgtctgcctgatgcagatatttcactccatcggaaacataagtttcaagctgaattttttccgcttcacgatatgcagtttcatccgcataattctgcaattcttcaattgccgatgcaatggctgattctaactgtttttgttcggcttcttttaaggtttcgatttcataaatcttctgcttactgtctgtcagaatttcattcatttcatccatactctttgcagactgtaatttttcgacgccttctgctatcagagccgatacctgtacccagttttcttctgtatattcctctgcttttacaaaagtctgtaaatctttgactgcccctgcacggaactcttcgagatttaattcccattttaaaatcggaaatccatcctgtgtgttcatataatctttgataaaatgatttcccgatgcaagcagtgcatttaagaaactctctgttttcatcttatccgcttccagatattccccggtacttgcacttccgtttaataaaccaactaacggaagggaggcatttgccggatttttgagcgccgtcagattcgtataggttccatctaacattgctccaaagagtgccccgatacattttccactgatattcaggttcacatctccaatgttatagcaacaggaaatctgtgaaccgcctgaggcaccggtcataacaccaatcagaccgcctgcataagaatttgccagtacatctccggtattatagttggatgtcactgcaccattacttccactcatacgtccaaccagtccgcctgcacaaaactctgcttcaacactgccacggttgacgctctggcgaacacttacagaatttgccatatctccaataattcctccggcatagaactggattcctccggcactttccagactgacatttcctttatttgagcactggttcacccacatcttatctgcataaccgacaattcctccgactgctgaacgttgacgttttgcatttttcacctgaatctgcacttcactgtgacagtttcggatataatttcgctgactctcattttttccatgcatgtatgccacaattccaccggcataagcaattttttcgctacattcaatacttccctttacgataagattttcaatgctttgcttttcgtcgccatatacgataccaaacagaccagagtatgtgtcaccgctttcgattctaagcccacgcacaacatgatcctgtccatcaaaacttccggtgtatggaatcttagaactgcttccgattggtgtccagttgtgatttccaagattaatgtcatcgcacaattttgcatttgctttcgcccctgttacgccggaattcaccagttgtacaaaccacgcaagttctgcaccgtttgaaatctgatagtatccttctacaagttccggttcttttgtgctctttccgtcccatgcaccttcctgcggaatattatttaaaatctcatcgatttgtttctttgcctcagcaagggcagaagcgacttctttgctggttttcgctgactgaatctgtttttctccgtctgcttttgccgtttcgattttatttttccaggtttcctcaaccgtaacatccgaagcataatttttcagttcttcgattgcagacgctttgatttctcctaactttgcactttcggtatactcgatggacaattcattcaaacggtctttcgcagtttttaataacgcttcgacgtcggcaatggtcagggcattttcgatttcatcttcaaattgttcttctgtctgttttagctcggcaatctgttcctcactccatttttcactgccctgtaagagttcttcctgatactgtgcaagctctaagattgcattatttcttgcctctaacaatttggaatcgacttccgaaccaggtttgattttttgaagggcttctcttgcctctttcatgacgctgtccaaatcatcctgagtcacaaccgaatcaattttctctaaataattttccactgtctgttcgattaaaatataagttgttccatatttcttcttattttcctcgctttgccagccctgtaattcttcaattgcagaatcaattttgctctttaaatccgtcgtctgttcctcaaaagccagtttaggatacccgcctcccgcatcaaaaatacttgctttaataaaagcagaaccaagtttcgttatcattttctggcttttcattgttttttcgatataaagacccgtctcgtcaataatttctgtcgttttatcttctttaaaagagtataaatccagattgtaggaagaatcagctcgaagtgcatacacgcgtccgatttttccacttttaaaaataccgataattgcgcctctgtattcaaaggttttattcgtatagactgcaatgttataggcatttttaatgactggctgtgccggattctcttcttctttggtatcggcataacccagtttaccgacgattcctccgacaatcgttcccgtataggaaaccaatcctccaagttctccctgattgtaaacattttgaatcagacattcttttaccgttccatctgcatagacactgctttcattgacaccaccggcaattcctccaatcgtatccactccgctgatttttgctttattgtaacaattctgcaccgccgcgccctgatagactcctccggcaattcctccaaccgaataatacccctgcactgcttctttattttcgcaataacgaatgactgcatttggtccgacttccattccggcaattccaccgatgttatgctgcgcaaatcttaccttggtagaaagcgttccattattgacacaacgtctgactgtcccggaacagattccgacaattccacctgcattacgacgaagggcttctcctgccatcgtggtttccgtatagttggtacagccggatatggttccgctttttaaataaccggcaattcctccgcttccgatatagagtttttcatactttccctcggtcttataagccgcataattattatgaacttctccggatacttttacattggaaatggttccaccatcaacaacaccaaataatccggcataacgcacgtctggattttcttctgaaatctcggcatctaaaaagtataccgtatatccatttccgttaaatgttcctttataggcatgttcggcagtatcgccaatcatcagccatttattttgagacgttccatcacccagataaattttatccgtcagttctccgtttatcgaacttgcgccgtcatttactttctttgcaaaccacgcaagctctgctccgtttgaaatctgatacgttccattttcatcggtttttggaacttcggttgtctctccatcccaggcattcataatttttgccgcctgtacttctctttgtcccatgacaggaaccagagtcatactaactgccagggcaagcacccatgccagcagtttctttccataacttttctttttcattttgattccaccttacaggaaataaataaatttcaactggaatcgttccagccatcctgcttctttgtaaactttttcccagaccttattcttaaattccataacaaaatctctctgttcttttgctatgctgtggctgctgtaaacggcttcctgtctgatatctaccaccttggtatattctattttcatttcttcatcaaacaagctttctatctgacttccataacgatacaaggaagcatttcgcactttcaaaccaaagactgctaaaatattcatggtatattcaaacaatgcattgactgcctgattataatcttcactgtcaaataattgttttatcttctgacagcgaatccgctcacggatgatttttacaataattaaaatcaaaaacaaggtaatcagtacaatcaagataccaagaagcatttccagtatcaaaatccagtcaatctcatcttcctcttcttccggttgttcttcgtcctcaagattatcctgttcatcctgttgttcctgctcgtcatctgctccgatacccgaagtaattcccgagatatcctgatactcttctgcggtctccataattccaagataggaaggagtcgattcaaatggaagccagccaactccatcctgataatattccacccatgcatgtgcatgcgttccatctacggtataaggctctccggctttcatacttttgacatcgtccggtgtaatcacatacccctcgacatatcttgccggaattttataataccggaacatcaatgctgccgctgtcgcataatgcacggaataaccttttttggtattttcaagaaaattcgttaaaaaatccaaatctccggtttcttttttgatttcttcactgtaagtacagcgggaactcaacacatataaaatattctgtttcgcctttgtataatcaaaatgagtactgccatttgcaagggtatactctccaagtacctcttttaattctgtctcaacagactctgggagttccaaattggtctcatagacatattgattataaaatgcttctttttcactgtacgcttttccctcttcatccagattttctgtatctgcaagttttgcggtaagagacggatattttttaatctgattttccaacgccgtataagtatattttcgctgtccctttaagccttttgcaataacaccttcatctccgattcgatttttatcaggcgttgttccggtaagttcataaggtgtgtacagataacggctgtcctcttttaagttttttatggtgacagtattttccggttcttcttttgtcgtctcatctaaagctaaagatgcaagcggtaaggtttcctgtccgaaaaatctatcctgatgcagccagtaaaataaatccgaagcgttataaagtacttttttatcggttgtttcccaaccatgtttattgtaaacactgccggtgtatcctcttaaataataagactgtgggtcgctcattgtcacttcaagcaccgcatcatcttttaatttcaaagaagaaagtccttcaaaatctccttttggcatcgcatcataacttccaccataccgccagtcttctattttttcttttatcgaagcttctaacttgctgactgtttcatttttggagtattctttttcgggcacaagcagcatgaaaataagtgttacaaacaaaatcatacctgctgtaaaacaggcactttctatttttaaggcactttctttgcttccggtttcctcttttcgatgcatccgaaaccatatcaataacaatgcacctgaaaatacaacattgaaaacaaacgatggaccaaatccgagcacaatctgtaaggttatccacataagtccaatcagaccggttatccaccggttttccatcttgataaatacggtacttatcttttcgataaccacaaccaataccgccatcgtaaccgaaagtttccacttgtctgacagatctccacctgataccggatactgcggataaatataaggaatgtgctgtttgatttcatctaaaatctggtttaaaaacagattccatccatccagtatcattttatgaaagaggagaagcaccagtatcagcaccaaaacttctgcaagcagtgcatattttttcagttttcctttccactcagcttcaaaagaaagatacaccgcaaacacaactcctgcaatggcaggcagtgcatttacctttattccaaacatgttgcagacggcgatgcctgtcagcattgcaaatatccataccagcagtccgtctatgaaattttctattcttttttgtttttgatttttttctgtctgtacagcaacaagcagaattcctgtactgtttttttgattttttttcatgaatcgaaccacctataattttttctcttgcttgcggaattttccacctatatttcaagatatgagagttccgcttcggcattttctgtcgatacggaaatcacatgcgccccttcctctgtaaattcgcctctcggctctttctcacaaatcacttccgtcaccagacaccgttctgccaaagccgaggcatctgccgtcagatatggagtgaatagcaccagatgtgcaaactcacattgttctctctgttccatgtaatgaccgagaaccgaagttccatcttctcccggaaccgctgaaagaagttccggaagtatcattgtaaattcttccagactgtcaatttccgcactgctgtaagtctgctctttatggttataccagccaatactatgtacaatctgctgttcgcacatttcctgtgaaaccgataccagacattctaccagcttttccatctgcgatggaaattcttcgcttttttccggatatccggtctctagtaaaagtaaaatggtattctgcaccgggagtccataatctcttacgattaatccatctaatttttctgaaagtttccaatgtatctgatgaatgtggtcacctgcacgatattctctgactgcaaatgtttcacttgggtcaaatccggctttgctcatggaatattcttcggcatctagcactgcattttccccataaaccacttccacctgaagtccaaaagtattcggagtaatcaatgtcattttttcagaatctgctagaatttttgtttttctaagtccaaaataatccattaccaaaaatccttctaagcccagacaaagttttccgcagtgcctgctttttaattgtaactgctgaagtgtttctgtttttgcgggagcagaagctaaaatctcatactcttctgcctctcctgtcagcatgttttcgcattttatctttgcaattattctgtcaaaggggaacaaacctgtattcttaatctttaacatggctgtcatgtctttttgtttttcacccagattgtctatgcctaaagttccgaaaagtttttttgcacaaatctctgcccctatcatctcaacaatcggaagcaccaatgaaattgccaacagccacagccctgcataactatctgtaaatacataaaacatcacgcataaaatcagttcgagtccccatagaatccttgattttgccatagtctctcctatcgaccattatccggcgattttgtctgttttaaaacttctattaaaacatccgaagccgaaagtgctgcaatttttgcctttggatttaaaataatacgatgcgcacagacgtccaaaaagactttctgcacatcttccggggtgacataatctcttccctgtacgtaagctcttgccttggcaagtctggtcaccgcaagtgcccctcgaggactgactcctaaacgaatcatctcctgttctctggtattcattgccagagaggtaacatattctaaaattttatcttcaatgtaaatctgtgtgacttcatcctgcatttctaagatttcatcggttgatgtcacctgctctgccttatcgagtggattctctgtctgacggtcacgcaggatattgacctgactttgaaaatccggatatcccatttccatacgaatcataaaacggtccaattgtgcctgtggcagcaactgagttcctgcagaaccaaccggattctgggttgcaagtaccacaaacggttttggcaattcatgcgtctctccatctactgtcacctgtccttcctccataacttccagaagcgcagactgcgtcttactggaagtacggttaatttcatccgcaagcaaaagatttgtcataaccacacctggcttatattcaaatgttccactttctttattatacattgaaaagccaatgatgtcggacggcacaacatctggtgtaaactgaattcgatgataatccagacctaatactttagagcatgcaagtgccagcgtggtctttcccaccccaggtacgtcatctaacaaaatatgaccccttgataaaattgccatcaatgtcttttccagcaccgcttcttttcccacgatgattttatttaattctttcagaatttcttctgtttttgtattcatctattcctgcctctcttttcctgattctttatttttctgtttcttttaccattctttgccataattaccctgaacatttccgtatacaccttcatttccatactgaccgatatcctttcctcctgccagggtgtaacggacacgaatttcatctccgtcagaaagatttctgcttgccattcctgttccgacgtaataattattgacgcagaccatccagcctgaccattgtgcaaaatctttttcccataaggcatcggtctgatagcttccggtccagcccattccatcctcaataatcatctgtttcaattcatccggtacacgaagaccatttgtcattcccggctttttgattccggcaagataataactgttgtccacacttcctgtaatcatagaagtaaaactatattcagcaagctgttgttcgactagctgtgccagcgtggtgtttccatctattgttacttcatgacgtggaatcaacattccaagaccgactgttccggcttctaactggaaggtaacggtaatctgggacggattataaagtaccgtataggtcttcgtcgtctcatactgctgattatcttttacagaaatgacaacttcattttctccctgctgaagatgcaggagatattcataagcagttccggaacaaccacgatattttacttcttctccattgacgtaaatgtgcatgttgtctgcacttaatgcgccaccgccaccactgacttcttttgcagaaacattcaaatccacatattcggtgttgtattctgattttaaattatgttccacaaccggtgccatattggatggtgtctcaccggttcggttaaattcgatattccaggtataactgcccgaatttccattggaatcaataaatccaactgcaattggcatctccctgtctgcatacagagaaattgtataccagccatttgaattggcagacggcgagtatgttccacctctgctgtctccgcagaccacacttgtaatttcttcttttccggtaatctgactgtgattgaaacggaaacgaaaactatttgtattattttcatatcgaaacgtctgagaacctccgctcatctgcggggtaatcgtactcgaatttttttcaccctcaagcgtcaaagtaaaatcgtccgcctgtttttgagaatcatagtaaattgtataattctctgataccgttgctgttccggttcccgcaattaatgtaaatacattctttccttcacttaaagtttctgtataagcggtatctccatcggtcgattttagggctttttcactatttcttcggatgattaattttacccgctctgttccttttaaggcataagcggtaaaatcaagctgttgttcctgcaccgtctgtccatctaatgcttttaactcatcggcaataatcaaaatctgattggatggattgtaataaatcgtataggttggagaagagactcggatattgctccatttatcacgaaatgtcacataaactgtaactttattttcaccttcagaaagagtaatgcttccgttataattctgctgattcccatttatgtcaactaccgtactaatcacagaaagtttggaatgatacgtaattgaaaatggatattctgcttccgttacaacttcgtttttcaaacttgtcgtaaaatacgcttcagaattttccggtgctaccacaatctgttttccatctttctggctgtccccgtcgccgtctccttttccgttgccattgccaccggttccctgaccactatttccggaatttccatttcctccattttgactgtcaccgccggatggtcctgtaccggaattattttttgttttatctttttttacaattggaagcaagctgtcaagttgttccgaattactgtcaagaggagtctgtgaaacctgctgctgttcctcagaagtttgctgttcctgtgtttctgtagaattatccgaattctcttcttgattttcttcctgctgttgttcttcttgctgctcctcgtcctgattttcttcgtcttgttcttcttgttgctcctcttcctgttcttcttgattctcttgatttcccgtattgatattggcattctccacactgtccagaagtgactcatccatggccagactggaggaggtcacatacatacgggatgggtctgcattttctttttccataggattttccggtgctgcctgattctgtgtcacagatacgacaaaaagcagcagaaccaaaatcactgctgctacggtcataaatgatttttttatttttttccagaaattccgtaaattcatatcttctacctactctttttatatagagaagaacagacccctgtcgccagggtctgctcttcctttgttttattactgtttattactgtactgtttttttgtaacacattgattttctatcaaatgttagcctgtccgtacactaattatctgcttcttgtgcgtacaccggatgcatttacatagtagtttccaatccatgtattggttttcatagcaccatcattggctccgccaaagtagtaccagtttccgccaatcttctgccatccggttttcataacaccatcatttgctccaccgaagtaatatttctttccgtagatggtctgccagccggtcttcattgctccatcattggaatgacccagccagtaatattttccataaactttctgccagccggttctcattgctccgtcgcttccaagccagtaatacttgttgtaaactttctgccagtgtgttttcataacgccgtccgttccaaaccagtagtatttaccatctactgactgccagtaagtcttcattgcgccatcgtttccaagataatatttcttgccatcgatcgtctgccagcctgtcttcattgctccgtcgcttgcatttccaagatagtatttcttgccatcaacggtctgccagcctgtcttcatcgctccatcattggcatttccaagatagtatttcttgccgtaaacagtctgccaaccggttctcattgctccgtcgcttccaagccagtaatacttgttataaactttctgccagtatgtcttcatgattccgtcagttccaaaccagtagtaatttccatctactttataccagtaagttgcctgtgtaccatcttctttgtagtaatatttcttaccgtcgatggtctgccagcctgttttaacaaccagtccatctattgctgactgaagtttttcagtcatttcggcaacctgttctttggattctggattttctgctaccgcttctgcttctgcaatcacatcctgtaatgcattgtaagattcatctgtgtatttggaagcatctgttgcttttgccgtttcaattaaatcctgaagtttgtctgtatcaattgcggaatttccaactgcaatcatgtacgcagagtcattcttgaagtaaatggtgccatctttgtctaccgctacgctggagatgcagtattgtttgtgttccggtgtatacagaacctgacttccttcatctggttctgtcatgccaggagcatcttttacaacccagaggtttccgcttggtccgtttgttgcaaagtatacatagttatatcctttgtaacctgttgatacaacacctgaagtctgaggataagcatctgtgtatactacatattcaagattcattgcacctgtttctgcattaatatctacaactgagattccataagttccactgaaatttgaaccgtaagaagaacctacataacagcgaccatttgcgattgccggagtacttgtgctcatttttccgatttcgattggctcaatcagattttctgtatcaattgttccgtcttctttcaggttataggaatacagatatccaccttttgatgtaaaataaattcttccgtcataataggagatatctgaacggatatcgccatgatgcggaccgactttctgaactacttcaccagtcagcttatcaaagcaatatacataagaagaatcacttgttgaatcggattctccatcatcgcttcctacgattgcgtatttatcagttacataagcacctgcccaatagaatccaccctgtacggcataagtccaggttgcatattttgtttctgtcggattatctgggtcttcatctgttgcagaaacacatacgaagtttgcatcttttgtttcactgttccagaatcctgtataaatatatccatcagaatactgaatcgtacagtttggctgtcctccaagtgtatctttaaatacccataaggattccagagtttctgcattaaatgcctgtactgctccacctgcaagtcctacaaaaatcattccaccaccgtagcatggagggttgattccaaaactactgtttcctgccatcggtgcacttgcaatgatatcaccagtttctttattaattttaagaagctgttttcctgcatagcagtaaagattgttgtctacgataatcggagagctgactgcccagttgctgaacccttctccgactttcttttcccatttctggaatgctgtttccggtgtggctgctgtctttgcacttgttacagcctgattacttccatcttttctaaatccagcccagtcacagtctaaatcttttaagttgctgctctgcgctttttccagagaagctttgataacagtgtctttctctactgtaatctcttcatgttttgttacataaccggtcttagataccgtataggtataagttcccggaagaactttataaatgccgtcttctccgcctgctttgattttatctttgtcaataactgtgataattgcatctttcggttctgtttcaaaagtaatcgtaacaggttcttctcttaagatagaaactgtatatttgcccgcaacagtattttcatttcctacctcaatttctgtaactacttttgcatcgtctccggttaaggcaagtgtgtattcaccgttttctgctgtctttccgtttactttaatttcagaattggcagcggttcttgcagttgctttaaatactacgctttctaatgtcttaggaacaacaatcgtatattctttttttcttgcattgaaaaccggatctaatgtcacttttgttccatctgcttttgtgacacttaaaccggaaagggtcgtctcacgaataatatgaactttataagtttctgttttaccggtttttgaagctacatcaattgacatttctcttgcttcaatgtcagactgaagcacacgatttacaccgctaaactgtgtaaattcatttgccggcatagcttttgttaaatcttttgtatagttatagtttttgtagtttgcagtaattgtattaacttctgcatcatcacttaaaaccggttttaaataaaatgtatttaccgtttccggtactgcaacggtacattcttttgtctttgcatctaattcagactgcatcgcataaacattttcaccgtttttatcggatgcaaatacaaactcttttaccataggctgtgcagcacttactgttacttcacaacttgctttgaatgttcctgctgttacagtaattgtagcacttcctgctccaactgcttttacagttgcgctcttgccttcacctgttacggttgctacatttttatcatcagattcccatttaacatctaaatcttctgttgcatttgcaggttcaaatgttacatttaatttgctttctgcatcttcctttaaactcaggctttctttgtccagagcaatttttgtcactgcaatctgttctactgttactttgcactctgcactgactactgtacctttattattggtaaaggaagccttgattacagtagtacctggagtttttgctgtaatttcgccattctgtgcgtttatatcagcaactcctttatcagaagattcccatgttaaagccggtgccgtttcacctttttccagttccggtgtataagccggtgtcagagtttttaccgcacccggagccatggaaatttcagttccctccgcaaaggaaagatctgttacggttgtaccgtttgaagtaacttttacatcgcaggctgcttcaacggtgtctcctaaggtattaaccatagaagctttaacggtagttgttcctgctgattttggagttacgactgcacctgtttcagatgctgtaaccgttgcaacatcctgattactggaagtccagtttaatgcctttgatacggttgtctgagccggtgctgtaaaacttgtcagtaaatcgatatccgaaccaacttctgtttcgatttctgttaatgcagcatctggctgttcctctgttgaaaaacgaagtcctgttacagcatccgtatcatagttaagctgggtattccaggaatcatctgtggtcagacgacagtcatttgtcggattgtctgaccagtaataaatcagacggcatccatcctgaagctgggcagctccatcataactactccatccattggaattaaaagagccatctgcgtactgaacgataacagaccagtatcctttactccagtcactctgtaagtcaactccgtccttatttttcatatcatctgggaagcagctgccttcatctgaaaaatgatagtcaatctttgcttcttttaatgcagccttaatctggtctttacagttttcagccacataataactttccagactgtttacatcaatattaagcggctggtcttttaaccaatacacatatccggtatgttcatccagatttttactgtgatttccggtatcgccgattacagttaaggtaatgcctgtatttgtatctgcttttgcaacaaccggataccaacccgttgcaacagttgatacaatcattaacatcgccatcagcattgccagaaatcgattgttctttctctgtttcattttgtttcctccttctttttatgcgctttgagagtgcattatttcttttgcgttatataaaaaaagaccttcccatcaggaaaggtcttcatttatccttgtgtctactgtgttataatgaaatagttcataactatccgcagtatttttcactctatgtattctactgcaaattcaaactttttacagtatgcttctactttgctgtcttttctgcaccgtatcaccgtacttttgtttacaatccagtctccgataaattccggttcatgagcaatctcaactactttcagacgatgacatccatgaaatgcccattttcctatccgcttcacactttctggaattttcacggattccagattgttacattttaaaaatgcactgtctccaatctcacgcagtccatccggaagttccagttcttttaatgctgtttgataaaatgcctgagaaccaatcttccgaagtgccaatggaaattctaccttttcaagatttaaacatttataaaaggcacgacttttaatttcctggacagactttggaatcttaatttccttcagactttcacatccataaaatacctcttccgcaagatacacacacgttacactttcaggaaaagttgctgtttccagtttcttacaccgaaaaaaagcaccttttccaatgtactgcagttttttggaaaattctgctttccgaactctgatgcaacacgaaaatgcttcctgcttaattctttctatgttatcaaaacacagttcatttaaagctgtacaatttgcaaagctctgttttccgacttctgttaccgatgaaggaatctgtactcttttaatttttacgttattcatcagtgcttcatcttctatctttctgcaatccgaagccagtaccagttctttttcccgtactttctttccctgtgctctggtaaaaacatttttttcttttgctttccacgttaatatttgtcccattgtcttatccattcttttccttttcatcaagctaaattggtaaagaaaaagaaatctcccagatcacgggaaatttctttctttacttttcgcatgccagagttgctgtcacatatttaaaatgtttattcacatacacaaaaataaatttactttcttttcccgaaaataaatttaaattcacaaaacggcagttttctggcttcacaacatctgtgttacagtaggggaaactgcgccggtttctcaccgagcttaccttttaacctatcttaaatcattttttctgttttcattatttcgtcaaggaccgttttaaaacttatttattttctgtaattatactttatttttccatttttgtaaagcaagtttgaaactttcttttagcaatatcagactttttatatgcaacaaatcctgtcgtcgtgattatcatctcggtcaccggaaagttaaatcatcggagcaattccatcaataaactttttcacatagaaaagagccgcaccgattgccggagtgtactgtccatttgtcccaactattagattttcttttggaaactcaaacggaagcgatgaattgatctgttttaatagataattcaaatcattctccataaaatagggtgccagatacccactgataataatcggtccgtcaatgaccagattcagatttctcatggcaaatgccagatgttttaaatactctttccagatttgctttatattctcctctttattttctcttagtttttcaaaaaattcctttattgacattcctgcaatttcagacagtgaatttgcggaacaataggtttccaggcagccacggtttccacaataacacagcggtccatctgaattaatgcaaatgtgttcaatcactccgctatgcatgaaacttccttcatgcacctttcgatttgtaataatcgctccaccaaggttgcgatttaataaaaacaccactgcactgtcgagttccgaatgattccataattccagataagcagccgcttttgaatcatgtaccagacggcatggataaggcagcttagaagaaaaatcagacagacgcatcttcacattattcataatcgtaccatacatgactctggaaccatccggagaaataattccctgagttgcaatcgaaacaccaaggattctttctttctgatatttgtattcttctataaattcatctattttatttgctaccttttcataatattcttctgtatcgctataatccaaatcaatggtgtcttttgcaatcacctttccatataaatcaattgcaacaatataaaacattttttttaaaattccaattcctattgaaatccggacatctgatacaatctgaatcacctgtgcctttcttccacccgttgattcgaaatagccatctctttgaatcagaccttcttcttcaagcacatttaaattttgactgacagtagacagacccatctttaaatcctgcacaatctgaagttttgaagtctgtttcgtacgataaatatattgatataccttttctttattaatctgttttaatgtaatcgtagtaacgcctcgttcgctcattttgtcctccttgcttttccatacttttcagtcatagttccattttaatacagtatactatgaaacgcaaacaagaatattttatgtgcattttaaccaaaatgagttttaaaaaattgttttttatgtcaatagacatatttttcctcttattatatacttaacttacagttaagtaataagcgtaagtaaaaagaaaagtattaaaaaaaaaaaaagaaggaggacggcaggtcgctggttttaagagccatgttattgacaccaatggtgccggagattccttctggggtggattcttatatcaaatcaatcaggtcggaaaacgaccggaagaactttccttgaacgagttggacaactttgcacgattcggcaatgctgtagcaagtttatgcgttgagaagaaaggggcaatccccgcaatgcctgatttaagcgaagtcgaaaaacgagtcaagcggatattcgacaaataaacaaaactattcaatataagaaagaaggaataaaacatggatttaacaacttactctaccggaatccagcacattggaattcctacaaacgacattgaaacaacaattgctttttatcacaaacttggatttgaaactgcatttgaaactgtaaacgaagaagccaatgaacgtgttgctttcttaaaattaggaactcttgtcatagaaacttatgaaaataaatcagctaaattagaatccggtgcgattgaccacgtagctatcgatgtcaaaaatatcgaagaaatttatgactatattaacgaaaacggactgaatacaacttccgatacgattcattttcttccattctgggaaaatggagtacgcttcttcacaatcgaaggaccaaataaagaaaaagtagaattcagccagtttttgtaaaactcctactggtaaaaaaataatttaagaatgagggtgtcccaaaactatgatttataaagtcagacatagagaggggcatccttcttctctttctttaaaataacgatttccattaaaaatggcactggtttcttatccttccagtgccatttttgcgatattatgggcaattgccaacagtccccattcaattttaactttgtctgctccacgtaaatgaaatcgtcggaatgaccaacaacctttgatcctgccgaagacctgttccacttccacaactctttgtgaacgaagcttatgtcctcttttggagcaaaggtttgcatttgctttcctttttagttcatttagccggtgggataccatgattgtacgatttttatctgtgttcttgcattccgttgcatatggacaaccagtacaatcctcgcatcggtaataatcccttctggtttcatacccggcttccgtcacatatttccggtttccaatatgtaacaactgctttccgttgcggcagacaaagcgatctgtttccgctatatagggtaagttatctgtcagatacggattctctctgtttttctttttcttttcccaatgaaacttgttatatttcacatagctgcccagattcttttcttccagatattcataattctcttcgctgccatagcctgcatctgcaacgatgttttccggtaatcgccctaatcttttttctaaatgttttaagtgggggatcatggttttggtgtccgttggatttggatggatggtaaagcctacaatatatctgttttcagtgccgatttgtacgttatagcccggttttagctgcccgttaagcatggcgtcctctttcatacgcatgaaggtggcatcatggtctgttttggaataactgttgcgtccttcaaatatagcaaaggcctcttcatatttttgttttcttggaaggatatcttttttgaattccttcgcttttttctttaattttttatccataggatttttggcaagctttttatctatgcttttcacaacaccttccacctgccctgtcgtaatgcggctgtttacgcccgtttcttccaaatcatcctctaaataaatctcattttcctctgccacaatgcggtctatttcacgaaggtggttctttatcttttcatccagtttgcggtcatagttgcctaccgctttattccatacaaaagtatacttattggcattggcttctattttcgtaccatccaaaaagtaattctgcaactttatgtattttttttcaatcaaaagtttgacgacttcatagaacacatcttctataacatccttcatatccaggcgaaagcggtttatcgtccgaaagtctggtttgtttccgcctgcgatccacataaagttgatgttttcccgaagagatttcgctatctggcgagaagagtatgttttctgggagaatgaatagatcataactttcagcatcatcttagggtgatacgccgggcatccgccttctttgtatctgtcgtagagtggttttaaatccaaacattccacaactgtatttacgacccgcacaagatgattttcaggaatgaaatcttcaaaagacagtggtaattgtaattgagccatagtataatctttaaatgtaggcataccttattatatcacataataaggtggaaatggagaacggcgtggtaaccgttctctatttttttacacttttttacggaaagcaagagggcaacccctcaagtcatttcatgacttttgggacaccctcttctcccgttgaccggagattctgaaatacgcgggccggaatgattccttcccggaagtccccgccggtctccagagcatcggccctggcggaaaccggccacagggaaaagccagggcagccgccagcagcatgctgcatactttatatttcatagcttatctctccattctgccggtcctctgttttctgccatatctacaacctcctgctgtaaaagccttttagcccccgcccggacagaatccgggcagaggcttctgactgtttttctgtttttttatttttccgccgtgcttctttttctgctgaacactgcgaggacaatgcctgcgcccaccgccagaatcagcgccgaaacatacggcagcagatccgtttcatcaccggtctggacacttcctgttcccgccgcgcctccagctgtggaagaacctgtaccgctgccggatccgtttcctgtgtctccagtgcttactgtagacgcgtccacaactgtgccgaacttgcccagcgtgctcaccgtcactttcagaaccccttctgttactgtcccagtcagcgtttctactttgccatctgccacatgcagaaccttcaaagtctttccgttgtatttttcgcccacctggatattcagggtgatctctccctccggctgaacttcctgtccatccttatagagagccgcactgtacaggcgaatcagggcttccttcgaggtaatttccttctgcatcagctttacatcactgtcaaaagctgtcagggcttccagtctcagttcccagccgctcaggccctttccggtcacagatatcggataattctggtatgtcagtgtcacctcttcatctggagtcggggtcggcgttacatccggcccatccggattctcagcactctccagctcctgaatcctgttctcgcatttttccaggacagccatcgtttcttcagttacatactgcttctgcgcgtccgtcagcgcttcataggcctcgcgggccgcctccactgccgctttatccgcaagcgtcagcgtgtctgccgccggcaggctgttgatctgctctgtcacggcgtccgccgccgcctgatcggccgcctgctcttcaagtattgccatctgttccacggccttctgtaacttttctacaatgtctgcagaaatcaaggatttctgttcatccgtcagcgcttcataatgcgcattcgcagtttttacagccggagcatcttccaatgtaagctcttctgcagatggaagagatacaatttcctgctccacctctgcagctgcctctgcatcatccgtcagctcagcaatctttgcttccagatttgcaagcttctgtacagtctcttcagttaccagcgctttctggtttcccgtcagcgcttcataggcctcgcgcgccgcctccactgctgctttatcctcaagtgtcagcgcgtctgccgccggcaggctgttgatctgctctgttacggcgtccgccgccgcctgatcggccgcctgctcttcaagggctttcagctccgcctccgccgctgtcagaacgctgtaattcgtcacatagctctgctgctcctctgtcagcgcgtcatatgcgttccgggctgcttcaatagcctcccggctatccagagtcacggttccgatctcttcaatcagatcgataactgcctgcgcttcctccggtatctgcggttcttccggattggagggatttgcaattgcatccctcagggcctgctccgccgcatccacagccgtctgttcgcaggtaatgtcgctgatggccgctaccgcgccttcgtaggctttctgcacatttgcgtactccagcagctcttctttatcctctctgccgttaaattccgccagcagcttcgtaatactgtcgccgttcacattcggtacaaacggatcgtccacgtaaccgtttccggaacagagatcccctttcatcgccgtaaaacggatccggatcacatctccgtctttcggctccgtatcactcatgcccacattcggcatatcattgttcagcgtatacatccagccggactgatgattggtataatcaaattcacccagcgtggctcttcttctgggatttgtaattttaatgccctgttcttccgcgtgcttcagggaaatctccggaaactctgccgtcaggcttcctgcctcatccagaatccaggaaagatagaagctgctgtctacgcttcctgtattgtcatagcgaaggccgttttcacccaaaaccctgtcaaggatctgcgccgtggattcgccttctgtgatttccaccaggacaggctcaacgagataaccctggccgatggtgaatttttctatggcgactgtcacgtacgcctgttccggctcttccgcatcttccagctcctgaattctgttttcaagctcttccagagctgtcaccgtctcttctgtcacatactgtttctgtgcatccgtcagcgcttcataggcctcgcgcgccgcctccactgctgctttatcctcaagtgtcagcgcgtctgccgccggcaggctgttgatctgctctgttacggcgtccgccgccgcctgatcggccgcctgctcttcaagggctttcagctccgcctccgccgctgtcagaacgctgtaattcgtcacatagctctgctgctcctctgtcagcgcgtcatatgcgttccgggctgcttcaatagcctcccggttctccagggtcacggttccgatctgatcaatcagatctataactgcctgcgcttcctccggctcttcaccgcccataacgtcggtcatatcatagatatcgttttctcctgccgcgaatctctcccaggccgctacggccagaagggtctgctgcgtagccatttcatttacggcgccgcccttcgtatgggcgaaaccgccgctttcgattctgtactcatctgtcgcggtgaaaatattcgcgccccaggacgtaaatccactgtcatcatccgagggggcgatgcccagcatcagcagcgtcaggattacctggtcgttggattctaccgtaccgtagtcgcccatgttaatattgcgcttcaggtagtccagcgctttatcgacagccgcctgcacatcctcccggtctgtatatctggacagggcctgcaaggacatggccgtcatatctatggagcctgttccggataccggtttggaaagcacaaagcttccgtcatctgcctggaaggataaaagctcctccatcagcgtatcccggttccatcggcttccctctggaatatttactgcatttgcatctaccgccagcaatgcgtaagccgcctcattggtgccttcgctgatcctctcgctgtccagtatccactggatcaggtctaccgtacttccgtcctccatctcaatgtttctggggtcgagtcccagggcatacatagccagagctgttctttccagatccgtgggctttccgtcagccgtcagatcaccgtactcgtctgccagctcctcctttacagaagcaagataagcctctttatccactcccatgtcgataccggcacgctccagagcgatgatgttccactccatcccgtatgtccaggacggttcggaaccttcataatatttctgaatagacgccttccaggtgcttacaagctctgtggtatccggaagcaccggtttctctccaccgcttcccacatgaatggtaaatgtcacggacgggcttgtaccctcggcagccgcagccggggttcctgtaatggtaacggttccttcctttacgcccgtcacataatagttggtattggagaaccagtcgtactcgctgttcaccccgcgggtcacttctacttctccgtcgccctcctgggtccaggtgatcagggcctgggacggctgctgcggggtataaacgatgggcagggatgcctgctcccctacctggatcgtcagctcgtcttccccggcttccagtttttcaatgggatgctcccagtaaaaagtcacatcgtcacttgcggaaacgggattctctccatcctgcacggatgcggtaaccgttatcgttcccgcattatggccgatgattccattctcaaaagtattccaccactctcctattgtttcatcgctgctgctccactgtacgtcatggatatagcttgcatttgccggagtgacggtcagggccgcattcagtatattctgctgaagtccctgatagttatcgccatttccaagggcataattcagccggtgcagcgggaaggttttcggaagctccagcttcatgctttctatcgggacatatgtagattccatatggatcgtgtgcgttttcccctcgccgtatgttattatcagatcgccttctccgggctcggtaaattcaacatacgtaccgctgtcgtagacagaaatctccatccggtcattgccctggatctcataatccgctctggaaaggctgacaaatttttctgtcccctggtattttccggaaattgcaagttctacggacgcgctgccttccagtgtccatttgcctccgtcagctacagtctcatcattgatattcacccggagctcctctatctcataggcgacggcctgcagcttaaaacggaacaggataaaatcataggtaccggtcagatagggagacttggagccctttaacgcgacctctacggtatccggcgacgtcacagttatatctccggtataggtacctacgcccacgcctttattccagctttcctcgtccagcacatcccatatcgtcatttttccggctcccggcgtatagccctccatcacgacctttccgcttccggaagttgggatggtgaatgtggagccattctctatttccgtcttttcaccggtatcactgttttcataataaactttcaggtccgcaacttctacggtataactgtaaatagcctctccttctgcgttattcagagaaaccttcgtttcacccgcacccacggctgtcagggtgccagccgactgtacctctgccacctccggattggaagaaacccattcactggcgtctgccacgttctggtagctgaattttccggtatctcccacaggaatggcaaagcggtacccgttatccagcgtaatgcttctgttttccgagtcctgatggtaggttacagacggatccttcgcaatatccgggtcttcccgggtcagcgcaaagctgaaatacaccttatcgacctgatagctgctgttgtaatgtacgacgtctacttttgaggaaaccgccgcatccgtaaagtacaggctgtttcccacccggtagaaattactgtctccaaagcgcataccggtcatactggactcttccgccggcacgccctcataatacagctgtacctgtccgcttgcatattccggggcgatattgacggtatcacccgcctggacttcctgcggatcgccgtcgggcagtacataatatactttcacggaagactggggttcctcgtccagggctgcgtaagcctcctccgccgcggtcagcgtttcataatttgaaaccagcgccttctgcccgtctgtcagggcgtcgtacgctttccgggccgcatcgatggcgtccccgctctccgctgtcacctctccgatggcatcgatcagcgcttccactgccgctgccgccgcttcatcatctgaaattgccgcaccctgccaggacagcaccggataaccgagaccgccggcatctcctgctttataggcgtctcctccgttattcagagcgcttaaaaattcatccatatccttcgggatctgtgacgcgtacgcatcgtctccggacgcgcagtagttattgcttcccggcgcggcatcggaatatcccaccgctttagccgcagtggtatagcagttgctgaccgtcgtttccgcgcttccgtttcttccgataattcctcccgcgtaagcaaagctggttcctcctgtcaatgttcccagagaataacagttttcgattacgcaggctgcccgggcttcacctacgattccgcccacatgctccatggaatccgccgttaccgccacattcgtataacagccggtgatggtcgttgagccgtttgcccgccccaccagtgcgccggccgggctgtagccgggatgatttaccgtaccttccagtcccaggttctgtatcacggcgcctttctccgtggaaaagaagaaaccggccccggaaatttgcagtccgctgattacatggccgttcccgtccagggttccggcgaagccgctgactggtgtccacggcgccgtcagttcgatatcagacataagacggtaatttccgtcagccgctatttcccgcagcccgttctcgtcataaatctctaccacgccgcccagcagggctttatatgcctcttcggccgcctccagaacatcgtaattggaaacctgtccctgctcctctgatgtcagactgtcataggcctcccgggctgcgttaatggcatcgtcgctttccttagttacctctccgatggcattgatgagctctataacatgctgtacagcctctgtctgatctggctcttccggctgttctccctgatcatgctcgttcaaaaggcgtacggtataggttgcgcccttatactcaatcttgaactctgcagatccctgctgactgagcgcgctgtccagagcggctttcaaatcagcggaaataccaaaggttccatagttcgttgtgctgtaatcataatcactgttttcccggatgccgttaaaatccagatacaggttatatgcatccagtccattcacgtccttcagagctatgccgtattccgtatagctctgaagagggctgttatttttcgttgtccgatccagaagcggtacttcaatcaacccgctttcgtccggataccatgccttgtcggtctccagcccgctattcagatcatactcctgcagccagaacgacgcgctctcatcattccctgtccgctccgcatctcctccggcagcatataccggcaggcttcccagaagcatgacaaaggtaacaactaccgccagaatacgtttcatttttttcttcatgttcttcctccttcttgttatttcattttctcctgcttctgtccggctaccctcctctaaaacatttcatgcattttctcccttcgcctgttttttcctgctatatctgcttctaaataaactggctatatatcgtttatttcaaacaaataaaaagcaccatccttattatatcacataataaggtggaaatagagaacggttaccacgccgttctctatttttttacacttttttacggaaagcaagagggcaacccctcaagtcatttcatgacttttgggacaccctcattctttttttctatccataactttttgatataaatagaatcaaaataaatgatttaacgaatttttgaacttatgttatgattacaccatcaaataattaacaattagaaatctattttactaggaggaaacacatgtcagagaatacttgtcttgaaaaacagccattatctcaggaaatgttagataaaatggatgcttattggcgtgcatctaattatttatctgctggtcagctttatctcttagacaacccgcttcttaaaaagccattgtctatggaccagattaagaaaaaaattgttggtcactggggaactgtaccaggtcagaactttatttacgttcattgtaatcgtgtaatcaaacgttacgatttggatatgattttactttccggtccgggacacggcggaaacttcatgattgcaaacacttatctggaaggctcttacagtgaaatttatccgaacatcagccaggatgaagaaggtatgaagaaaatgttcaaacagttctccttcccttgcggtgttccaagccactgtgctccggaaactccaggttctatcaacgaaggtggcgagcttggttattctatcgctcatgcatttggtgcagtatttgataacccagacttaatcgctactgtagttgtcggtgatggtgaagccgagacaggtcctctggctacctcctggcaatcaaataaattcttaaacccaattacagacggtgctgtccttccgattcttcatctgaacggatacaaaatcagcaaccctacaatcttctctcgtatttctcacaaagaaatcgaaagctattttgtaggatgcggttgggaaccaatcttcgttgaaggtgacgacccaatgacaatgcataaactcatggcagaagctatggatactgcaatcgaaaaaatcaaagcaattcaggaacatgctcgtaaagaaaacgatgcggaacgtccagtatggccaatgattattcttcgtactccaaagggatggacaggtcctaaggttgttgacggacttcagattgaaggttctttccgtgctcatcaggttccgattacaatggaaaaaccggaagaacatctcccactgttacaggaatggttagaaagctatcatccggaagaattattcgacgaaaatggtcgtctgattccggaactggctgaacttgctcctaagggaaatgctcgtcttggttctaacccacatgcaaatggtggtcttttactgaaagacttaagacttccggatttccgtacttatggaatcgatgttgaccctggaaaaacaaaagctcaggatatgattgaacttggcggatacatccgtgatatcttcaacttaaatcaggataacaaaaacttccgtatcttcggaccggatgaaagtatgtccaaccgtctctacaaagtatttgaagctgaaaagagagactggaacgcagaaatgcttgatacagatgactgcctggcaagaggcggacgtattatggatagtatgttaagtgaacatatgtgtgaaggatggttagaaggttacctgttaacaggtcgtcatggcttcttcgctagttacgaagcatttatccgtgttgtagactccatggctgcacagcatgcaaaatggttaaaagtctgcaatcagctttcctggagacagccaattgcttccttgaatttcattcttacatcaaatgtatggcagcaggaccacaacggatttacacatcaggatccaggattccttgaccatatcgctaacaaaaaagcagacgtagttcgtatgtatcttccaccggatactaactgcttattatcctgcttcgaccactgcatcaagagtaaaaactatgtaaatgctatcgtagcatccaaacatccaagttatcagtggttaagtatggaacaggctgttaaacactgcacacagggtgtaggtatctgggaatgggcaagtaatgactgtggtgaagaaccagatcttgttatggcttgctgcggtgatacaccaacacttgaaacaatggcagctgttactatcttgcgtgatgaacttccggaactgaagattcgtgtagtcaacgtagttgacttattcaaactggagtccaaccacaaacatcctcacggattaagcgacagcgaatacaatgcactgtttacaacagacaaaccggttatcttcgcattccacggttacccaactctgattcatgagttaacttaccgtcgtgacaaccagaacgtatctgttcatggttatcaggaagaaggtactatcacaactccattcgatatgagagttcagaatgaaatcgaccgtttcaaccttgtaaaagatgctatcatgcaccttccacagttaggaaaccgcggttcttacctgattcagaaaatgaacgacaaactggtagaacacaaacagtacatcgcagaatacggacaggatatcgaagaagttcgtaactgggaatggcatacaccagaaaataaataattaacgttttctatgatacaaatttctctataaagtaaaaaaccccggaactgttatctgacctccaacagctctggggtttctattattctctatcatatcagccagagtaccacgtctataatacttgcataggcgtgggtgaatggctgtgttttattttattccctgatttttaatataatttttcactacatccagagtattttcacttacggttgcaataaaataactgtcagaccaaaaataaggtttccagtaatactttttaagcagtgtatcgccataaagcttacgaactttgcgggacgtctgagtttttattacattgacaagttctgacggaggagtctgcgggttcgcttcaataagcagatgtatgtgatccagtttcccatttaactcaagtatattaaaccctctgctttcagctacataattaatccgttcatagacagcagtttttacatcgccggtaagaaccggatgtctgtattctgttacaagtactatatgatatcccgcagatcatggtgttaatttaaaactcccgggtagaaaggaacgcctttatctttcaaatgtagaagcggattccgtcctcaaagaggttaaaatcaagccttattatggaagatacatcctgtgtcttaccctcgaaagtgaaaattttgccgcagataatacagacatgcccaacctatgcgccatagactttggtgtgagcaacttcgcagctgtcgtatgcaatgattgttcatcaatgctgtacaagggcggagcggttctgtcagagtgccagtggtttcacaaaaagagagccaaagctgtcagcattatcacaaaaggccatgaacacatgcatgccagctccaggtacctgagcgccttaagcaggcatcatgccgatttcattaaggaccagtgccataaaatcagccgcagcattataaactactgcatggaacatcacgccggtacacttgttcttggcgaaaacaaacgctggaaacaggactgcgacatgggttcacagaacaaccagaactttgtctcaatgcctacagggttgcttaaaaggccataacggatgcatggaacagcataactgctttttcattcctcgcatcacctgaagtgtcaggattccacgaactgaatcccctaagtatttccgtaaaagggatagcggccgcgtgaacggcctcgacaggtggtggacagcttataaaacgcaataaaatggtgtgatatgccattttattgcgcaaattcttttttgtttgtagcgtttttataataataaaaaaagaaccctttcggattcttcttcatgtttcttataaacatgtaccttcaaaactacatatacaaaaccgaaaccatgcagacacttgccgctccactgatttctcagcttctggtcaagccctcgaccgattagtagcagtcagctccatacattgctgcacttccacctctgccctatctacctcgtcgtcttcaaggggtcttacttcctaagaatgggatatctcatcttgaggggggcttcacgcttagatgccttcagcgtttatcccttccaggcttggctactctgccatgcagttggcactacaacagatacaccagcggcctgtccatcccggtcctctcgtactaaggacagctcctctcaaatatcctacgcccacgccggatagggaccgaactgtctcacgacgttctgaacccagctcgcgtaccgctttaatgggcgaacagcccaacccttgggacctactacagccccaggatgcgatgagccgacatcgaggtgccaaaccactccgtcgatgtgaactcttgggagtgataagcctgttatccccagggtagcttttatccgttgagcgatggcattcccacttaataccaccggatcactaagccctactttcgtacctgctccacccgtcggtgtcgcagtcaagctcccttctgcctttgcactcttcgaatggtttccgtccattctgagggaacctttgggcgcctccgataccctttcggaggcgaccgccccagtcaaactccccgcctggcattgtcccaccgccgggtcacggcggctggttagaaacccaatactgcaagggtggtatcccaacatcgactccgtagcaactggcgtcactacctctttgtctcccacctatcctgtacatgcaataccgaatcccagtaccaaactggagtaaagctccatggggtctttccgtcctggcgcaggtaaccagcatcttcactggtacttcaatttcaccggatgcattgccgagacagcgctcaaatcattacgcctttcgtgcgggtcggaacttacccgacaaggaatttcgctaccttaggaccgttatagttacggccgccgtttactggggcttaaattcaatgcttcgtttcctgacatctcctcttaaccttccagcaccgggcaggcgtcagcccatatacctcacctttcggtttcgcatagacctgtgtttttgctaaacagttgcttgagcctattctctgcggcccgcttttacacgggcaccccttctcccgaagttacggggtcattttgccgagttccttggcaatgcttcttccgtcggccttaggattctctcctcatccacctgtgtcggtttacggtacgggtacgttacaaacaatagcggcttttcttgacgcatggctcacacacttccctactctagttcggtccgcatcacgcctttggattgtcacacggtttttcctatgtgactcctccttcgcttgccccgggattccattcccgggttgtgctttccacacgtgtccccacagttctgttctaacgcagtacaggaatctcaacctgttgtccatcggctacgtctttcgacctcgccttaggtcccgacttacccagggcagatcagctttaccctggaaaccttagatattcggccataaggattctcaccttattctcgctactcattccggcattctctcttcaatacagtccacagctcctttcggtactgcttcttcccgtattcaatgctcctctaccaatgtattactacattcctcagcttcggtgtcgtgttttagccccggacattttcggcgcaggacctctcgaccagtgagctattacgcactctttgaatgtatggctgcttctgagccaacatcctggttgtcttcgaaatcccacatccttttccacttaacacgtactttgggaccttagctggaggtctgggctctttcccttttgactatccaacttatctcgtatagtctgactcccgataatcaattccatggcattcggagtttgatattcttcggtaggctttgacgccccctaggaaattcagtgctctacctccatgtatctctatcgaggctagccctaaagctatttcgaggagaaccagctatctccgggttcgattggaatttctcccctatccacacctcatccccacccttttcaacggatgtgggttcggtcctccactgcctcttacggcagcttcaacctggacatggatagatcacccggtttcgggtctgcacatactgactctggccctattcagacttggtttccctacggctccacgccttaggcgcttaaccttgccagcatgcacaactcgccggaccgttctacaaaaagtacgcggttccgcatataaagcggttccacagcttgtaaacacagggtttcaggttctctttcactcccctcccggggtccttttcacctttccttcacagtactatgctctatcggtcactaaggagtatttagccttacggggtggtccccgctccttcccacaaggtttctcgtgtctcgtggtactctggatcctgtcttgtcctctttcctttcccatacggggctttcaccctctctggctggctttcccaaaaccattctggtagaattaaggaatcaattatacagtccgaaccccagcatgcacgcacactggtttgggctctttcccgttcgctcgccgctacttaggaaatcgagttttctttcttctcctcggggtacttagatgtttcagttcccccggttcccctccatacgttatggattggcgtatggatacatgaggtcttctcatgtgggtttccccattcagacatctccggctcattggatatttgctcctccccgaagcttttcgcagcttatcacgtctttcatcggctcttagtgccaaggcatccaccctgcgctctttcttgcttggccattcagatcttatagcgttaacatctgacggctggtgttgcttggtttgtttctatttcttcgctgtatttctacagcgcctcgtttcgtctctatcttacgttttacgtattttagatgtttcgtatatgcagttttcaaggtacattcagatgtaagtttttgtaatgccatgaccggtagaactttgttctggaggttgcgagcatcacactcactcttattcatcttttggctgttttatcagccattcaaacacaaaagctttttatgcttgaatcactggtaaaatcaccatttgcttattttattttttgtaatccggcagccacctgctttcccatgccgtctccagcatagtatcatcggccgcttaagtcttaaccatcgtgttcgggatgggaacgggtgtctcccctaagcgcatcgccaccggaaatgtttggttattaaattttagaagttttccttccttaataactcaacagtgaaacacttcttaactacttcttcttccttagaaaggaggtgatccagccgcaccttccgatacggctaccttgttacgacttcaccccagttatcaatcccgccttcggcagctccctccctaaggttgggtcactgacttcgggcgttactgactcccatggtgtgacgggcggtgtgtacaagacccgggaacgtattcaccgcgacattctgattcgcgattactagcgattccagcttcgtgcagtcgagttgcagactgcagtccgaactgggacgttatttttgggatttgctccccctcgcgggctcgcttccctttgtttacgccattgtagcacgtgtgtagcccaaatcataaggggcatgatgatttgacgtcgtccccgccttcctccaggttatccctggcagtctcatcagagtgcccagctctacctgctggctactgacaataggggttgcgctcgttgcgggacttaacccaacatctcacgacacgagctgacgacaaccatgcaccacctgtcttctctgtcccgaaggaaaggttccattacgaaccggtcagatcgatgtcaagacttggtaaggttcttcgcgttgcttcgaattaaaccacatgctccaccgcttgtgcgggtccccgtcaattcctttgagtttcattcttgcgaacgtactccccaggtggaatacttattgcgtttgctgcggcaccgaagagctttgctccccaacacctagtattcatcgtttacggcgtggactaccagggtatctaatcctgtttgctccccacgctttcgagcctcaacgtcagttaccgtccagtaagccgccttcgccactggtgttcctcctaatatctacgcatttcaccgctacactaggaattccgcttacctctccggcactcaagaaaaacagtttccaatgcagtcctggggttaagccccagcctttcacatcagacttgctcttccgtctacgctccctttacacccagtaaatccggataacgcttgccccctacgtattaccgcggctgctggcacgtagttagccggggcttcttagtcaggtaccgtcattttcttccctgctgatagaagtttacataccgagatacttcttccttcacgcggcgtcgctgcatcagggtttcccccattgtgcaatattccccactgctgcctcccgtaggagtctgggccgtgtctcagtcccaatgtggccgttcaccctctcaggccggctactgatcgtcgccttggtgggccgttacccctccaactagctaatcagacgcgggtccatctcataccaccggagtttttcacactgtaccatgcggtactgtgcgcttatgcggtattagcagccgtttccaactgttatccccctgtatgaggcaggttacccacgcgttactcacccgtccgccgctcagtcccttacatcttcccccgaaggttctgtcgtaagcgcttcgctcgacttgcatgtgttaagcacgccgccagcgttcatcctgagccaggatcaaactctctgatatagtgtttgtccaagttcaagataactacttggctatctatcccttttactgttttggttcattgaaccgttctttttaaaataaatgaatgtaaaagaattttcgttttcatgtgtttcactgttcagttatcaaggttcctgtcgttctttttatcagcgacagcttctatattatatcaaagctgtttttgtttgtcaagaacttttttaacttttttcaaagtttttttgttttgactattcgtcgttgttgtcgtttccgcgacagctatattagaatagcacacctttttttaattgtcaacactttttctaactttttttaatattttttcattcatggaaaaatctacaattgatacatttattgagttctgttttctcctagtgtacagcgtccaagaacaaacttacgaaatacagtagatgcaatactttgaggatactctaaatcgtatactaatgatacacttctgtccggcatttcatctaatatttctatctgaaatacatttccgctcatcattgcctcttttacaaactccggtggcaaaaagccgattccaagattatgttcaattgccggaagcagtaaatctgttgttgcaaattccactgcgggttcaaacggtagtccgcgctttgcgaaataagaatccagaaaaatacgggtaatcgtatcagaggtcagactcacccagggataatgacacaattcacctaatgtcatcatacgcccctttagatttcgatattttctacccgcaattaaaatatctgtataagaatgaacggtatgttttataagagggtcttctatcgcaaatggaatagaggaaatcattgccatatcaacctggccttttttcaatacttctattgatttttgggaactattatttaaaatcttaaatcttacctttggatgaactttccgaaatgcctcaattgcctgaaacagacaacaatgaagtgctgtttcagttgcactgattgtaatagacccttcatctaccgacattaaatttgtaattttttgttctccacggaaaaactgtgcacatcctgctgagacatattcatagaaagttttcccctccggtgttaattccattccacttttgcttctaataaaaagacggcatcctaactccgcctccaatttatggatcgttcttgtcacagcaggctgactcgtctgaagtgctgatgcagcctttgtcagatttccatattttgcaacataataaaaaattctataatattcaaaatttgagttcatttttttatcccgctctcttacctctgtccgcttcactttctgctttgttttttcttcgtgcatcattttatgatgtgagtgtcaaaagtaaattttgccactcactgatgtaaccggattgctccattgctacgcaattcctgcaatcctcgaacacctcaaactcccataaaatggcggtattcacaccattttattacgttttcgttgttcggcgtgtcaattaagtatgaattgctttttgtgcaagcgcaagcgcaatttatacttttgacacttacatcattttatcacaaaaacaaaactttttgaaactattttctcttctaatctgtctaataagtgtaagataaaaaaaacatatctaaccgaaaggaggtttaaaaagttgactgatttaattaaaaaagcaatttacggcgataccgatgcttttcttgaattgatggacgtcaattcactggcaatgtataaagttgcaaaaggaatccttggaaatgatgacgacgttgcagacgctgtccaaaacactatcctgacttgttttgaaaagcttaatacgctaaaaaagccccgctatttcaaaacctggatgattcggattttaattaatgaatgtaataagattttaagtcattataagaaattcaactgggatgaagaaattcctctcatcggacaaatggatatgtctattgccgaatttgaatttaaagaaatgctcggacgtattgatgcgccttaccgcattattttactgctttactatgtagagggctttcgtatctccgaaattgccgaaattctggatttaaataaaaataccgtaaaaaccagactttcacgtggacgacaacaggcaaaaaaagaatatcttccaccagcttcaaaaaatgatactcttccacaaacaatttctattcaaacaagaaaggggtaaataatatgattgataacaagaaacttaaaacaacgttaactacaaattttcaacttccaaaacaagtcaatcaggcaaaggaagaagcgtttgcaaaaataaaggcatctaaagtctcagaagcagcaaaaacagaagtttcttctactatttcttctacttctgaaacagcttttgctcccaaaccagtttttacttctgaaacggattttatctccaaacccgatttcactcacactccttcaaaatccggttataagcaaaaattttacaagggttttgctgctatagctgcttctgctgccattttttccattatatgcaccgcaaatccagctctggctgataatattccggtggtaggaagcgtgttccagacacttggaaaatcacttggattctacggcgactttaaacattatgccaaaccgctcgacaacaacagttcaaaagattcttctgctgattccgatgcatctgcttcttccggtgaaactaacaccgcatccgattctctttacagccagacgcaaaatgggacaaccctgactttatccgaagtatactgcaatgacagcgcactttatttatctatgaccattcagactgaaaatgaatttccagactgttttttaaatcaggatcaaaaaccgattattttattcggcatggattctactttaaattatagcttcaaaaatacttctgaagataatacacttttaaatgcttatctggatggaaagcagattgattcccatacttatttcggcgttctgcgcctgaataaagaagatattttgactagtgaaaacgaatccattccagacaactttaatatccagcttaatgtaaaaaacatctgcggttataaaccggacgattctgctcctgaaatgccacaggacttaaaagatgcctatcagcaggctatggctgaaaatggtttagatgaagataattataaaaattttacggaagaacagcaagaaatcgaacaccggctttttacagaaatgtggaaccggtactatgaacgttatccggatgttacagaaggtctgaaccattataacacctggaccttagaaggggactggaatttttcagttgatattgagaaaaacacctccgactcgattacaaaggaaacaaaggcagttgattccgatggaaatggaatactttccgttaccaaaacacctttcgaaatttctcttgatgtaacagaccctgaatttaaatattttgctgttgtgcttgatgcagatggaatttactgtcagccaatggcacttccggctctgcatatacggttgctgttcaggacagcgatgtctcttctatctccgtttatttatgcgattatgatgaatatatggatgaactaaagggatattatttctcagaggattatcaggaaaaagccaaaacaaagacgtttaaacagcttctcgatgaacatgctgttgcaagtgatactattaactttaaaagataattactgctttatctaaccttaacaaatctaagataaaacccaggtactttcaatttccagtgctgaaagtacctgggtttttactctatgcttacggtattaggctgggtatgaaaacttactacctcacttcccaacgactccatttcttttgcattttcaggtgttgtatattttcccgtttcatcatacatcagccagtccggtgcatcaaaaaatgcaagttttggggaaacttcttcgtaaaaatcttttagaagcccgccatttccatgatgtcccatctgaatataatctgcttttaacttttctccccatgtatcaagcagataatcactcatcgcttttccaacatctgcacaaaacaacatactggatttttctccctgcaccttaaacatcatagaaccatcatttaaataatcctgtgataattcctttacatgttcatcataggcattataaatatcaactttaagcccgcagatattcagttcatctcccggataaacgtattttaaattttttacattcaaatccaaaaaatcattataagtatccacactatcccaatgtgcacgttcctgacacaatttcggtgacggcatatctaccgtataaacttccttgatttcaattccctgcaaatctgaataaattgcattaaacgctccaatatgatcttgatgtggatgggtcaaaatccatgcatctacttttccgcccatctctttaatcgtctgacgcacaaaatctgcatcttctgtccagccaccatctacaacaattaattgcccctttccaccatacaatgtataaaacatagaatttacatctcttggaccatattgtgtaatcagccatgtcctttccgtatcctcaattattttttcatactggataaatttaactgttatgattccgaataacaaaacgataatgaccagtgctacaccaatcattttgtttcttttttttgatttttttctcatcttttcctcatctaattttttatatcaattctccatcaaatgcttcactaatttcttcctttaattcaagaatgatttcctgatgattttttcccggaatcagctgaattaacttgattccttcctcttctttgtcaataatatttccttcatggtgtgttggatttaagacccatacacgatccacaggatttaatttgcgaagcacaaaattttcatccagccctctgcagtattttgaatgaagttcatttttatatccccgaatttgattttcacaaaatgacttcgtatccctattttgcttttttgttttatcctgaaagatactctgtatcttacgatattttacctcaaaaataatcgttgaccagtaaacatcttctctgtataagtccattcggatatcggggcgataatgtctgcctttcgtaaataccggctgattttcttttgttgtatcctctaactgcctgcacaatggttcatcataatgaagctttatccgaaattctcccttcacaaaccctacaaccgtacctgataaaactgcagatttcctgcaccgtttaccacacaattgctttcctttaaaccattttgcttcacttcttcttccgttgccaaaacacctagccagcttgtcttattttctttcataattcctatcttatcctatcttacttttttcttcttcgttacttgattcggttaaaatccgacattttcgacagtctttgttttccataaattgttttatttccattgcaggcaaacgcaatcatgcatacaattacaaaccacaccacatgttccggaccaaatacttcaactccaattaaaattggcgcaatcagggtatttgtcgcacttccaaaaacggctgcgtaaccaagtcctgccatcaataaaacaggcagacccaaagcagaagccagaatgaccccaagtgtcgcaccgattgagaaaagcggagtgacttctcccccctgaaatcctgctgcaagtgtcacaatcgtgaatactgcttttaataaaaaatcaaacacatagaccttttctcctgcaaaacttgcagaaatcagattcgttccaagtccacagtaacgtcctttccataaaagtaaaaacaaaattgaaaggatgatgcctgtaaagaaaatcctccggtaaggattttttataaatttcgccaatttttcttttgcaaatgccagaaaatacgaaaaggctccgcctgtaattccaaacacaatcgcaatcaaaatcaatttggcaatggtctgcggattcacagaaaacgtatccgaaaaagaaaccgaaaatttttccagtcccaataaatgagacgtgaaacttgcagtaaatgctgcactcattgccggaagcatcgcctcataaaataatgccccgacaactaatacttcaagtgcaaaaaaagtggctgcaagcggtgtctggaacaacccgccaaaacccgctgccatacccataatcaaaaagatttttccatttttttccgtctttccggaaatcacttcaaatttctttccgattgtatgagagactgctgcacctatctgaactgcaacaccctcccttccggcacttcctccaaataaatgcgtaagccaggtagaaaccataataattggaatcaatgccttcggaatttcttcattttcctcaaaaccggtttcgaaaatgagccccattcccttttgcgatttcgggctgattttttgatataataataaaattgccacaccggcaagcgccaaaaatggaacaagaacggtaacgtgttctcctcgaaatgccgtaatgcctaaaagtacccttccaaatatcgcatctactgctccaacgataattccaatcagaacacccatgattgtatagagcaaaaccggtatatattctcttatgcttaaatgcttcatttttctttgtctctctatctatttttttgcagaacagtttgtcagcttacattcgatttgaacttaatgaataaaatgggttgctactcgtttttctgtttccggcagaccaaatgtttcttttccaagtgcaatactcttcattaaaaatgtcatatttcttgcaagtgtacgcatggtctgttttccctcttcatccatctcagcttcacccacttttcttccgtgaatactgttccaatactgactggaagcaatcggcatgttggaaatagtaaaatatttattcagctcatcaaacgtagctgaacatccaccacgtcttgcgcagaccacacttgcacccactttcatcgttttatcaaatggtgtactgtaaaacagtcggtccagacatgcaatcaaagtcgcatttgcagaagcataataaaccggactggctaccacaagaccatccgcttcttcaaacttcgatgccagctcatttacgatatcatcattaatggaacatttcccgttcttatagcaataattacaggcaatgcatccacgaatggctttgtttccaatctgaatcgtttcatattccactccattttcggcaaataccttttccatttcttttactgcaacggttgtatttccgtctttgcgcggacttccatttaaaatcaatactttaaatttttctttcataagtcattcccctttcattaaataaagcgaacatttgcaatccgcttcgctacttgctcatgaacgcagtcgctttgcgatctgtcagtgggagctttcacctcccactgacagaagcatccccctcacccgccgcttagtgctctgcgcacttgaagcgggggaatgcttatctgcgttcaaaatattatttttattttatcacaacacgccctaattgactatatcctcccaaatgccaaaatgcttaggagttaaataaccgattgacagcagcaggaaacctaaggtaaaatattaataaactatatacctgtgacagtcatcagaaacagtaatgttttgagttaaaaagaaaatcagtgcaaatctgatacagatgattctactgtgagacacgcccccaaatatgcacaccggaggaacttcagtagcatatttttgcaggtcgttaagtcagagggcttgctgttacttcgttcaagatttttgaagaaaagaatcttttatacgcagtaacagcatttcataattttaatcaagtagtgtataaaagagctttgattcagaaatggagaaaggctcttttttgtgtataaaaaaatttttccaaaaaagagaagtgtatatagaaagtagaatacttaaaaaggagaaggagtatgaaaaaagaatttaagcgaatgcttagtattcttctggttctcacacttctaggaagtacgctgccgatgtctgtatccgcttccgcacttccggctgaaaacgcttctgcaatcgagaaccaggaaccaaccgatgcatcacaaaatgatacgcaaaatgatgcacaagatgtaacgcaaaacgaaacacaaaacgaagcacaaactgaagaagcacaagaatcccaacaggaagtacaagcttatgccaacacgcttccttccacaattccggccggggaaacttataccctgtctgaagatgtaacaatggaaagcggtcagtggtttgaaagtattgagggaaccttagacggagcaggacataccattaccctgaccgataagccactggcaaacaaggtaaccggaacgattcaaaatctgggtgtaacaagtgaaaaagtaattgaacgcgacgatactttcggaagcatggcaatgacttttagcggaaccattcaaaattgtttctctaccgctaagttaaatatgagcggctgggatgaaccgggcggattagtaggtactgcaaacggaggtgtgatccagaactcttattttgcaggtaccgtaaccggaatgctttccggtttttacggcggtttaattggtgtcaacaactcaaacgataccaaacttaaaaacagctgctatggacctggaagtatgaatggtgccgtaagtatgggtggcaacaaaatcactccggaaaacgtacagcaaaaatccttagaagattttaaatccggcgcagcaaacagcattttaaatactaatcttccggagaccggattttcctgggcaactccgacagatggcagcaatcagggatttccgattctcgtaaagggcggttctaccgaagcacagaaaccggataaaacaaacttacaaaaactggcagacacttgcagtgcccttaataaagaaggctatactaaagacagctggagtaaacttgaagatgcacttgcaaacgcacagaacgttttaaaaaatgaagatgctacacttgaagaggttacaaccgcaactgcaacactgcaggcagcaaaagacggtctgaaaaaagaacgaccgacagagccggtggcacctcctgctgacgcaagtcagattcagcatatctcaactgaaaatgatttaagtaagattaattccagttccgatcagtactatgtactggatcaagatattaccataaaagattcttacttctctatgacggaattcaatggcattttagatggacagggacatgccattatctttgaaaatgcaaactggatgttccagcatttaggggaagaaggcgttttacagaatctgtattttaccggtaccattgatacctgggaacaaagtggaaatggaccaatcggacaaaatttaaaaggaactgtcatcaactgtttttcagatgtaaaaggaagtttagcctgcggttttgcaaaacgtctgcaaggcggaagtattatcaacagctattccatcagcgaaggcaaaaaaggtgttttatttaatcagtataaagaaggcaccctgaaaaatacttactggcaggaaggacttgccaatccggctgaaattccggctgctgctttaaacaactcttctacaaaatcagaagaacagctgaaaaccaaagattttgtaacgctgttaaatcaaaacagaggagcaaatggcaccaaatgggggcaaaacagcaacggctacccttatttcggagaagataaaaattataatccggacaaaccaaatcttccggaaaacaaatatgaaatggttatggtaacggaagcaggcgaaacacttgccatcgaaaaccagacctttactgtttcaccggacgaagtaaatgcatttggaattgtaggaaacttccagttaaaaaacgtgccggaaaccagcacaatttcatggggcatttcagaagtaaaaccagaaggttccttaatgattggatccgacaacggcgaccttcgtatcgacaaagaaggatccgctaccgttactgcgacggaaacaaaggcagatggaagcagcgaagccgtagcctgggtcaaagtcatttcaaaagcgcaaaaattagaagcgatcaagctgtttatcgacggacaggatgtaaccaatcagacctgccaagttgccggctcagaagaaaagaaaatcgaagttaaagccaaatatcagggcagcgatgcttttgtgcctgcaaactcaactcgttttgcttacaaaaccagcgatgactcactcattaaaaactacaacgattcgagcagcttttcctttaaaaaacctggtaccgcaaaaatgattgtgacctcaaaagtaaacaatgctattaccgcagaggtggaagtgacttctacttatgtaccggcaacttctgtaaaacctgcgatttccggaaagaaagtcattcacggaagaaatgccaacgacccggatcagtatgcctttctcccggactacagtggcgtaattgtctctccacaaaatgcaagttatgcagataattggaaagtaacgagcagcgacgactccatcgccgaatatgtagaaagtatggtaaaaggatatgtaccatacaaagcaggtaccgttacttatcgtgcaacccttacacagaccgatccggagacaaaaaaagaatctaccgtatccggtacctctgatgtgacttatgcatatgaaaatccacttactgaagtaaccgcagtgcaagataaagtaagtatggaaaatttcacggaacaaccactggaattaactttcaagggcgaaaaatccgatgccggctggagcgttacttatccagacctgaaatggacctttgataaaaaaggtatcgttaagatttataaaaaagagccgattctgtggaaaaaaggcacagagtgggaaggcgcaccggatttcaattcggttgtcacaaatgatcaatattatgtaaaagcattaaaagaaggaacggttgtcgcaaccggtactcctcttgacaacacaaactccgccgctccgattcagattacaattgaagttgcaggcggtgaaactccacaaattaatatcgacgaactggtgcagaaaggtctgcttggcgcaaaagcacatttacaggcaatcagcccagaacagaattatgaatgtattgagcacgactggattgtttatgaccttcttcgtgccggaatcgccattccggaagaaaaacaaactcaatattatgattctgtagtaaaaaccgtgaaaggctggaaagcaaataagaaacctaccgaaattgagcgagttgccctcgtcttatctgtaatgaacaaagatattaccgatgtaggcggtgtcaatctcgcagaaatgatttataatcatccgaatttaaacagtggttctaacgaaacagcctgggcactcttagcactggatgccaagaaaacaccgattccatctgatgcgaaatggaatagagaacaaataatttccgcactgctgactttccagaatccggacaacggaggctttggattaaccgataacaaaactgcgggtgttgatacaaccgctatggcattacaggcactggcaccatacagacagaccaatgaggcggctaaaaatgcaattgatgccggtcttgcatatttaaaaagtgcaatgtccgattcctatgatatgggaactgcagaaagtacttcccaattattattaacactgattgcgctgcagattgatccattaaattccgattttggtacctcttatagtaacgcaattacaggcttaatggattactactgcgataccacaggtgcaactggtttctgccacgacaagactaataaaaaacgcaatgacatggccagtgtgcaggctttccaggcactgagtgcttatgttcactataaaaatggcggaaaattctattgggatttatcggaagatacaaaagaagttaccgctgcaaccgtaatgcaggcaattgatcagcttcctgaactgaacgagctgactttagaagacgaagcaaccgtacaggctatcgaaaacttgtatcagcagcttagtgaggaagaaaaacaaaaagtaacaaacctcgatgtattagaaaatgcacgaaagagaattgaagcactaaaagaccttggcgaccaaaaaggaaccgtttctctcactatcatggatggaatccaggcagacactcaggcactgagtgcaacagaagatccagccaccgtcagaggcactattctcgatgtgcaggttccaatctatgcacaagactctatgatgagcattattcagcgcgcttgtgaagaaaatgaaatcgatatttcccttcgattccagggcacttatatcgaacgaatcgacggactgtccgaatttgaccgaggctcgggaagtggttggaaaggtaccttagatggcgtcttcccagataaaagttttgctcaatgtaccgtacaaaacggggaagtaaaagatcactctgtgattactgtagagtacaccgaaaatcttggtgaagatttggaagcaaatgctgaattaaaaacactgggcttacagggcggtaatttaaaagaaacctttgagagagaccgttatgagtatactctgctcacaaaccaggatgaaatttctttcacacctgaatttttcaatcgctacagtgttgcaagcattgaagccgacggtgttgcgtatggtgtatctcaacagattccggttgaagtcggaacacagattcagctggtttccgaaaagaatgtgcgaggaactgaccgcagaacttataccttccttgtagaagcacaaggagaagaaaaaccgggtgagcaagaaaagccggacactcctgaaaaaccgggcgaatcggaaaaaccgggtgaatcagaaaaacctgacgaccagcaaacatccgttactctgctgtcaaataaaaagtatggtatttccttaaaaggtgaaggtctgacagatgatatggaactttctgtaaaaccgattaaaaatgaccacgaagatgttgctctgatgaaaaaagagcttccgacaaacaaatctttattctgcttatatgaagtgaaacttctgaagaacggaaaagagattcgtctcccgaagaaagcaacactttctgtttcggtcggaaaagaatatgaaggaaaagaaatgacccttttacattgtgtaaacgaaaaagtagagtctttaaaaggcacagtaaaagataaagtgctttccgtagaaatcaacagccttggcagcattggtgtggtaacggatgtcgctaaaacacaaaacggaaacaataaaactaccagtggaaacaataaaactaccgttggaaacggtaacacaaagaaatctccaggcgcaacagcagcaggaagtggcaacgctacttctgccggcaaatccgttaagaccggagatgagttaccacttggcgttacgcttttgatgcttttggtatctgcgggagctttaggcaccgtgggttataaaaaaagaaaagagagaaaataaagcactgcaaaaagtaagctaacacatttattaatgcctccatagaaaatatgggggcatttttttacgcttttttaaaccagcagtttaatgacaaatctttctttttactctatactaagtattgtcagcaagagagattacaaaaaaacgaattgaatatttgaatcatacctgcgatcaactcgatgaataaagtacgccagtacttcgaggtgtgtggtaaatccaatagacccggaaacgggtgaggggcgcccagtcaaccaaatcaaggatacttcttttggaaggctgccggggtttagtgataaatcccgggaagacggaaaccatcaacggaaacacatatcgcagaaatgcccgcatttaaaagcacggaacttctggatgcagcaatagacgcctacggtgtaggagtaagcctaaggggtatcagtgtggcaactgatatgacagaggtaaagccaacaatgcattctgccttgatgacggagaaatccgcctataacagaagtcgccggtgaaagtagccatatggcagattgacaaaaactcgtttattaatctgaatggacggtgaaatttacaggtagccaatcctgtgcaggcttgtggcgtaagccaagggtaagaagttaggggtcgctccccgaagctcagacttatcttcctggtggcagaatataagtgaagggcacggattgtacggcgaaggccggatcgtaggtatgattcagatattcaaagatttaaacaaggtcgttccgcctcaatcattttctgagacggaacgaccctttttttcgtacattcttatgctccaaattctatttttttcaccagataatctgctgtttcctcttaactatttcaatacttcacaatttttcaagcaccactccattccaattttcttctttccgaccattctaaaatcaaccatcaatgaagttttctcaactttaacgatttttccttttccataaattttatgtttaatccaatctcctgctttgataccttcagaaattttggcttcttcttttctaggagctgtctgtactggctgtccttttgaatttactccaaacaactctgcaaaagtatcaaaatcttttactttttctaccagacctgctcgatacaatcctacaaaacacgctgctgcctttgcctgacagttaatacttttggatggattaaactcaatatctgtaaatgcatcatattttaaaatttcttccacaagtttctcattttccaataatgcatttatataaatataatcataaaaaattgtctttggttcaagtggataaactctgttttcaaatataaatccagtcagcataccactggtaactaatcgtccatctcgttttgcttctcttggagaaacttccaaaatatctttatatggtccacctttttggaatgtttttgctgactgaaatacacattccaccggtactttcttcccgagttctggaacatatttctggaggaaaaaggcactcaaatcatttccatattcctgcatggatttacttgaaatttctaaaatttttttatctggttttcttcttaaaaactcattatgcatcgcagtaatattcttctgtttctgtacctttgcaaagccactattccagtcaaaatcaattgtcattgttctataaaacggtgctgattctttcgctacaaaaactggtctgtttgccataatagccctccactcattttctcttttcatcaggttattttgttgagtttattatagcatgaatttttatgaaaaaaatcaactaatagtttaatttaccgtggaaatactgttctctagttcaattttatttgcaaatattcttctgttgtcataatacttaaatgcaacggcgctaatccctctaagacttttattgtggcttcttctgtttcattatttacaccggcaactgcatctttaaggtaaattacatagactccagcatctatcaagctcataaccgtcgataatacacaacattcagcaactactcctgttacaacaacgcaagaggcattggatgcagcttttcttatttgttctatgctataagatgaatacacggattttgaataacatttatattttttctgtaaccctttaaaatcatccacaagttcatttagccatttatctgaattaacatctgaattttcaatattataatttttccaaattccctgaggttcatcggatgcgatgtattttgtgaaaattattttttcttctgtgtttgattctaataatttttttatctgattaagagagcgattaaaattagaacactcccatttttgtccatttgaatatacattttgcatgtcaattacaagtaaaagtggattttccaataattgtttattcatacatttacctcatgtcaaaatttgattttatgttttgatagaaaaataacattttaagatttaatgatggtatatcataaatttcaatcccttataggtaatgtgcaacaacagcatttcttagaaatcgccaaattcaccttgagactgaccgactttttattttcttcccttccaattaattttcttcattactttctgaactgcattcactactttcgacgacaaatacaccttaggaagttttcgttttgaatacgcccagacggaattattctgtgttttatttgtcaatacctctgtaaaaaacctttcccagctaacatactctttactttcaatataattttctggttttttgagaatatctgttatttccttatctgaaattacatttgacgcaagcaaaagccattcaaaagattctggtgcatataagacaacattttcaaatacatttacatattccataacctctttcatttcagaaccaaatgctgcaccatctacaattaccaattttattttactgtcattttgatttgcctgtaaagtcctaataatattagatttacctttcgcagaaacacatggtattgctttaactttcgacaattctgaaaaaaaatcatatcctgaattagaatcctcggtaataacatattcagggtcgacatttccttcttctgtcaattctccatagatatgataaatttcattgtacttctgttttgcttcatgaaattttcctgattttcgaaatccataaatttcatttacactgtatggaagcattggcagtttttcacgtgtcgcaatcacaaaatagttatccgatttttgtacgacacctgcaaattcttttgaaaataaaaaacgatttccctcatcaataaatataatactgcttgatatctcttcaatttgtcgtttccaatcttcattatctattatcctgcattcacaatcacaggaaacaaagacaccactgtctgctccatatcttctataatctcgaatcaagtcaatcaatactgtttttccagaaccactatttcctgtaagaatggtgatatttctttttacaacaaaatcatattttacttttcttgattcaacaataattctatgcgcacctctcatactactactcctgtaccatttgatttaggtatttacttgctataggaatcagctctttcatagaatgaacaacttctccaccattttttatttttatttcaaaatcagtgtcttttccaaagttcatcatgtgcctgagattaattgttaaatccttctgtttcgctatttctaaaatccattttgcacaattatcaccacaagtagatgcattaaaaattctatcaggttcatttagcattaatagtaacgttttcactccacctgataaccgctctggaggtatttgaccaagaactggacttttaatacattctccacccaatacttcagaatcatctacatcttgaatcatctttttagcaagttctgattcaagccactctgattcataagtgtttttaaaataaacatttgtattataaatacttctgggttcgtctccatatataattgtaagcatattttcccctccggaataatttaaaatactaatttctatttattatcttatcccatcgaaagctaaatatcaatgagaacagtgttttctaactttttgattatccatgagactgaccgactttttatttcgttttctttctattgaactggtatctccggcaaacgtttcctatcttaactttttcaaatacttttctgatatactttccatctttttttagaaaagcatctcctgattccactcatatcccaacatttctgcaatacgaactgccaattcgatgtctaccatatcgctaatcacacctaatgccatatcaaatccagccatcgttgaactgcaggaataaaattttccatcggatatccagttcacaccctctgctcgtctaatttcagcagtaaacattcgtttccagttctgatctcccggataatctgcaatctgtctatgatacaaaagcccggtctgtgctaatatagaagaagcatttgcaatcatcatacagatatctgcctcctgtgctgccgcttttataatttccaattttttcggttcaagacaaagcagcttcgttgcagtacgccctcccggaagtaccaatatatcttccacttcttccggaatcaatagttccgtccaaaccttcacaccttgtttactgctaaccagtcctccgtttaccgacaaataattaatataaaaatgttccggtgccattccaaaaatattagcaattcctaaggcgtctaacgtttcaaactcatcataaagaacaatatttacattcatcagtggatcccctttcgcatcactccaataatatttttattttatcaaatctcttgttctctaacaagccatacagggggataagttactcagaactcggaattttattcgccaaaagccgaacaactgtctaccaattatacttatctgtgatataatagtcgaaagataatcatattcaaacaggaaggatagatatactatgtttcagatttttgtagactctgctgccaatcttccggctgtaatagcaaaacaatataacatcaatgtcatctcttttattaatctgattgacggaaaagaagttacctgctataatccagagctttctttagaagaagaacgccaaaagggtaccgaatattataatgccatgcgcaaaggctgtgaaatcaaaaccggactgatcagcactgcaacatttgaggaacaattccaaaaagcatttgaaaaagaccaggatgttttatatttttctttaagcaaaaatatcagtggaaactttaactctgcacgcttagctgcagaagaagtgttaagtaaacatacaaacggccgcaaaatacgcttaattgactctctcaatgcgtctcttgcgcagggaatccttgcaatctacgccagtatcatgagagaaaaagggatggagattgacgaagttgccgattttttggagacttgcgtaggaaagatgaacggtatcttcacagttggcgatttgaaatatctctcccgcaccggacgcatcaagggaagcgtagcaacaattggaaatatgcttaagattaaaccgattttaaagggagataaagatggctatattgtcacttataaaaaggtgcgtggtcgtaaagccgctttaaatacactggttgatctggtttgcaataatatcgtagagcctgaaaaacagattatcggtatcgctcacgcggatgcttatgaagaatctctgtatgttatgaacaaaatacaggaaaaaattaaagtccgtgattttatcaacacttcctatgacttctgtacaggaagccatgtaggacctgatacaattgcacttttctttatcggaaacgatcgagaacttgctaacgagtgattataaaaaataccaagaggggcgtgaaaaatagctttgttcacacccctcttaactcatcactgacgaatatccacaatgcctgtttccagtgtactatccacaaactcgctgctgcttccatttccggataaattaaggtacatgttcgaaagttgattttcatccacaatccatgccatttctatctgaacacactctcctgattttaaggacgaaatatagtttccaccatttccataagcttcctgtacactgtaataatccatttcaaatgctttcgctacactgctcgaatgaatacaatcataattatctcccgattgctcattttcgatatacaattgataagtgtcaccttttgatttcagcaacatcagatttccgagatataatatatgattcaatgtaacttctgaattattcttataagttgccgtcacaaataccagtttttgtttcacattctcggttttcacaacttcatccagaacttctacaccatctccggtctttatataagaaagctgattttctactaattttccatcctcgccaactgcctttttccattcttccggaatcttattttcatctaataaacttaaatcatctgaaatctgaaccgaatccacttttaccgatacatcttccgattcgattgaattgccattttcatcttctgcagaaacgtctggggaaatcttaaattcttctcctgttttccagagtttcaattcatccgatgacacactcgttaccatttctctggtttctgtttccggctccgttgatacaaaatcactccagctgtacatatcttttgtcgcaaccatcttatctgttttaacaagagaaatattttcagcaaattttaccgcttcctcctttgacatatcatctcccacataaatgactgccatccggtattcatccggacacatcagataaatcctctggttatacgaaccactctgctccaaatcctgataccgaagataaacaccctcgtattttccaaaatttctttcttcactttctaccacatgattgtccgttaatacgctttcaaaatcctgtttatccaacagcatcaggctcattgaaaacccaccctgatacggtgtttccaaattagaaaattttccttcttctacctcttccatcccatccggaaggtagcctgcctgaatttttacgtctggaatttcatccggaatcgcagtcattttgctctgttcattggctgaaatctttgttgccaccttataagttccctgtttttccaaatgcatcgcataccatttggaaccggcataaacacttgtcgatacgcctaaaatacaaactgcggcgactgctgccacacgagttctgctccattttgttttcttagcattttttgttggaaataccgcaatctgctcattttccatctgtttttttatttcatcctgaatccgattatgaatcatttccggagtttttggcatttctttcttgatatcttctaatttcatacgaacacctccttatgttcaaatgctttttttaactttccacgggctcttgccagacgcttttgcactgcaccttctgttatttctaaaatctctgcaatttctctgatactaaaatcttccgcataatataaaataaccggaagttttaactcatcctttagttcagaaaccgcctgatacaattcactgtaatctgttttttccggctgttttcgctccggtatctctgtcgtttccatcgatacatattttttctgcctgcgaagcagactataacactcattaattaaaatccgaatcagccaggttttcgcatagttttcttttttcagcgtttccctcttttcaaatgccttcacaatggtttctgaaattgcatctgcacaatcctcatcatttccaagaatgatttttgcagtagcatataattgattttctgaatttaaaatcaactctcctaaattttctttcgtcaaaatatcaccacccttttctcgccggctgttcaatttcaagtcgaacactcgtgagacttggcgcgcgattctagtcagcacaagctgacaaattcttcttagaatcgctgcggtctacacttcgttacggtccgcgcagaaccattgtccattggacaatgtgcgccccacagagtgtttatctcagtcgtagtcttatcgactgagataaatttgaatgcaatgttttcttacatagattagacgtttatgaaaagaaaatatcccttttattctattatttttttattttgtaacctttttcctttctcatttgtgttataaatgaaaggacctttcaaaatataataggggtaaaaaactcatgagacaatccattcaggaattgattgaacgttatcagaataatctttatgcaattgcatttaacatctgcaaaaatccatccgatgcgcaggatgtcgttcaagatacgttcattcaatattatacaagcaaaaaagaatttgaagacgaacaacatctgcgagcatggctgattcgtgttgcaattaataaatcgaaaaatatgactcttactttctggcatcagcataaagtttctttggaagaatacatggaaactttaacttttgaaacacctgaatcagaaaatcttttcgaggaagtcatgaagcttccaaaaaaataccgaatcgtcattcatttattttattatgaggattattccgttaaggaaatcgcagaaattttaaagttatcacaaagcaacgtaaaagttcgtttatcacgcgcaagagcactgctcaaagaatcattaaagggggaatggaattatgacgaataaagaaaaatataaacaggctttttctggattgcatcccttagaaccaatttctctggaggtaacacaaatggtaaaaatgcacaagaaacacaaatttcaagtcgctgctgcaatccttaccgcattcattttagtcggaggcaccggaactgtatacgcagcaaatgttggcggaatccagcgtaccattcagctctggattcacggagaccagactgatgccacactcgatgtaaaagaagatggctcttataacttgaattattctgatgaaaatggaaatacagtagagcagggcggtggcggagtcgcatttgatgccgacggaacagaacgcccgcttacagaagatgaaatcatggaacagattaatatgcctgaagtagaatacgaagaagatggaagtgtctgggtttattacgaaaatcaaaaaatcgaaatcaccgataaatttgataatgataaaatctgctatgtgaaaattaaaggcaaagaaaagactctttatttaactgtaaaataccagaatggctactgcatttcagaagataaatacccaaaccctgcttcttttaactgattttttatttttcatacaaagcaagagcagttcagaaaattcattctgaactgctctgctttatttttacaagctctctgtaagagactgtaaattaattcactgattttttcttagcagatttctactaattcaatcttaaagtttaattcttttcccgccatttcatggttcgcatcaaaagtaatcacaccattttcttttgaaacaactttaaccgggaatggctgtcccattgcgttctgaagataaacctgctgacctgcttctaattcttcagaacctggaagttcactgatctgaacactgaaaactgcatccgggtttgccattccataagcctcttccggcattaaatgaatgtctacgacatcgccaacttccatatctacaaccgctttatcaaatcctttaatcatcattccagctccgctgataaattcaagcggttcaccacggtcataagaagaatcaaattttgttccatcattaaaagtacctgtgtaatgtactcttactgtttttcctgcattttttccctctaaaataatctgtggagttccacatccatggcatccgccaccgcaatctccaccacagctatgaccttcttcatggtctccacagctgtgaccttcttcatgatgatggtcacaagttacaccggcatcttccagagttccatctaaataatcctgaactgctttatctgtgtcacctgctgcacctgcacacacttcaattcctgcttcagcaagagcggtctgcgctccaccgccaagacctccgcagattaaaacatctacaccctggtcagctaatacacccgctaaggcaccatgaccacttccgttagaactgattacttcactggaaatgattttgttgtcttctacttcgtatactttaaagttttctgttttgccaaaatgctgaaatacttctccattatcataagttactgcgattttcattgtttgtattcctttcgttctcatataattctgatattttttctatagttcatatgataacatagattgtaaggaaaagctatttgttatttacatttcaatatgtttctattatttcatgtacattcaaaaattcatttttaatttttacattatttacattccaatatgtttctattatttctgtatgcgacaaaaaaggaccgaaaatggaaagtgcatttacattccaatatgtttctattatttcgagtcaaaaaggtctgtaatatgacatttcagacctcatttacattccaatatgtttctattatttcgagaattcatccaatgaaagcatttcttgaagaataatttacattccaatatgtttctattatttctaattcttccgtagcacattctaatacagcactgagatttacattccaatatgtttctattattcatcacctgaccaaccgttagtaccgattttaccgattttacattccaatatgtttctattattcaggaatgtgcatacaagcacattatgcgcatcctttttttacattccaatatgtttctattattcgacgattcaggtggattctatgaggtgcggacaggattttacattccaatatgtttctattattcccgtccaatgtagccttttataattccactactattctaccatcttttgtcgaccctgtcattatcttctgttttttcaataaaatcttctctttctttcctaaactctgcatttttcctgcaaagcgtcaattgtcgactccacgccttttttaccttatcacaggtcgacaattttctttctatatgaattctccatctgtttccaattcttcttgcataataagccccatgccttttcctgtttcaaactcaaactcatatttgtatgttgccctatggatatccataacttttcgttttcttccattaccaattgtttttttatcaactttttcagggaatttttgataaattggcagactgagtgttaaatcctggagttttgattttattagacttctcgtttctcttccaatgtttggtttactcaaaaattctattcctacatcaaatacttcttttttttcttgataaattcgttcaggaacaatcgtaatactgttaatatttcttacttctgcttcttttgccagatattccgtaggatgaatatttttaaaaagttttaaatattcttttatttcttgaaaatattgtgttccttcaattttttcaatatcatacactgcattcatataatctgttttcatcttttcagtaaacagttttccctcatagtctttcaaaagttctaacgcccgctcatataaatccttttcgtatacactgttttttccaaccccattttcactagcatatacatgaatatttgcttctgatggacaatatcttccttttcgattacatcttcccattcgctgtaagagactatctgctgtagacatttctgtgtataaaacatcaaaatctatatccagacttgcttctactatttgcgttgtaatccagacacctgttttatccgattctgaaaactccataatatttttttccagcagtgctctgtctcgtcttaaatatcttgaatgaagaagccatacattttcactttttaattccttataatgtcgttgtgcttctaaaacagtattgcaaatgactaatacttttttatgttttccctgttccaagatttcattatacacactcttatcaattttagaatcatgaatttttactctgtgtctggagttaatttctttctcctctacatctgatgtaaaatcttcaaaagagtattctagcccacattctttcatgaaatgctgaagaactggtgaaaatgtagctgtgataatggcaaattttccacccattttttgaattattgataatccatagacaatcgtcgcaataactcgtggttcatacgcctgtatttcatctataattagttttgaatattttaatgttgccgcaaatatttccgttccaagtgcccgataaacaaatttaaataactggtctgccgtgcatacagtcaacggctgtgacagcattttcgcacggtcatatttttcgcaaattccggcttcttcctgtttgtattcttttaaatatttcgccatactgtctgaatgaagcaatgctacatcttcataagagtatttttctcttactcgattataaatcgcattcgatgaaacctttaacggaagagtataaaatcctttttctccgtttagccaaagtaaggctgcctctgtttttccggaaccagtaggggctaccacaaccagattcttatctttattgtttatcataaaactctgtgctggtttcaagctatattgctttaaaatgtttgtggattcgtctgcatttccttcttccattttctgagattctaatttatattgatttaaaatatttgactttaatttcttttcatgtaaatctaccgcagtttctgcttcttcataacctgcacttacggtataatcaaatttattcagcataccttttataagcagatatttattccagatttctgaccaattttcgtactggtattccactattttactgctgtaaaggttgttccgaaataagagtttatagatattgctacagtacaatttgctaatatctttatttaaatattcgcttacctgctgcatataatattttcttccatattctctgattttttctccatcgtaatcatcttccctatcgtgatgataataaatggctgtaataaatggactaaaatcttcttctgaaaactcttctgataattttaaaaactcgctttttgaaagcgtaactgcacttaaaaatccatgcggaatctgctctagctttctgctgtctaactttgtttcttcatccacttccggattgaacatcagtgcttgaaatagaagattcgcttttccccaatcgtgtcttttacaggcttctaaaatcaacaatttttctctgtctgaaaaatatgctccatactgcttaaaaaatgcttccgcacatctgacaatttcttcttcatgctcttttaaagttttttgtttttcttctaaatctttacctaaatcgtctattgtatgatttataatatttatctctgtctcatcaagttcttcttgaagtttttccttaatcttctctaaatcttcttttaacttgtctttttctccttgagataactgccttttctttgtttttgcataatattccatagttccactcttttctggaacagcattatttttttataatactgttccttaaatgattaatataaaactattgctgcatctttttcatgttctgcatctttactttttttatttccatctttttcattttctgcttctctaatttctgcataattgtccgtatatgcgcctgtttctaacgtagtcccttttggacaataatatgctttcactcttcccccttcttttttccagcgtcgaagtccctgttttgtaatttcatattcacgggtcaagctatatacggtcatttgtttatttggaagttcaattttatcctcactgtttttccattcccattctaccggtatatacatatcccgttttaaatctacttcgtcctctcgatgaatttctacaatatcaactcgttcaatatccagtaaatcttcataacgacccaatgacaaatattgaggtggattttttaatgcatgatagactgtcataaaatcttcttcatttggaacaatatgaatcaccaaatgattctcacaaatgagttccacatttgcaattcccttaaacgctccatattttgttccgttatcttcaatgcagatattatgtctgccttctttaaattttgttcctgctgaaaaggtatatctcgtataaagttctgaaatcattccgctgtttgttccttgaatacaaagtttcatcggatgaaattctgtataaccacatgcagcatgaatcattccaagaacagtcgaatacggaggtaatggaaatgtctcttttatgataaaactacttggttttctataattcacaagattttgaaaacactgtaatctaattgctctctccatagtaactatccacttctttctttaaatgtttaaatacagttcccacagatttcgcttttaactctgctttgatttcagtttcattatcaaaaattccagatgtaattccaacaactgtgttttcttctatctcattgtcttcaatcagttctaatagtgtttccacattaattttattaccctctaatttaattctgttctcaaagaatggattctttctttgatatcttccgccaataataaataatggactcaaattttctcttctgcctctaatatctctatataaataatgcaaagaatctaacaatacttttacacgttctgctttttcctgacttggaatatcaatctctccatctactcccactctgtccaaatcaattgacacagtatacgcataataggaacgatgaatttcactctgtgcgattccattttctagtttttgccttacagcaagaccagcatttgtaagaaattccagatttccctgaaatggttctaacgcaatcgcattactcagtcttacaactgcacttctagtcgttgctccacctttctctttttcatcaccttttgatgttgttttcatataaccaaacatgtcaatctccggataatctttaattgtagcagatggtgcaaattgaactactttcttttgagcctgaaccggtgtattatcccaatttgcctgctgtacaatattgtaacgcattgcttgtctggaaatataagaatattgccaatcattccctcttgtcattttcttcaaagaagaaacattattaattccttctccatagtttgcactttctgctaaaaaaatcattgtaattgtaaatccatctctcttcatttaattattctcctttttcccttcgtaacagcctatcaatccagctacaaatgcatatccataagtagtaaacttttctttatcttccaacatttctattatacctgtcggtattaaaagctctggtccattttcattctttcttgaaccataagaactgtacaatctaaatacaacatccataaatctgtccacattttttacatacaacgcatttaataattgatattcaacccctcttaagcaatctccagaactggttcccttagcctgcataattacttttcttaaatctgatccgttttttttcataattccacaatccataataatctcctttcttttctcagctttatctacaatttcataccataattgaatttcataaatacaactagcataaaatttaaaaaattcatcctcaatacactcccttaatacacgatttaataactgatattgattacgctgttgaagcaaatttttaatcacactttcatataagtttggaatttcatttcccacttttacttttgaagaatctgcaaaccgttgtaataccgtcgctacacttggtttacctatcgttttcagcatatgtttatttataatacttagaatatacttatcttcatcctttgttcctcgtaaaattacttgtacattagaaaattcctgtagtttttctttcagtaaaatattaatagaccttgcaaaccacgcagaatatctttcattttcctttttttcaccatccacactggattttcctgattttgagtttgcagctatcaagacattgatattgttatttatatttacaaacacaaatttatctgcaaacaagcagaatcctaatggacttaatgcataaacaaaagcacaagcaggacaaagaaatgcatccactttacagttccaaaaagcagaacgttttcttgtaaaatcatctcccatttcattcataaatgcaatagaaaccttttcttttgcatttattggctcaccacaatctatgcataaatcttttgcttttttatggtctgctttcaaataactccgaaatggttctgaaaaatctttttcaaatagttcccacatatctttttttgcatttgcccgcagtaaaaaacattttccatcccaaaagcgattaatgtaagtatacaccacacttttcataataaaagtttcctcgcattttggctgtttcaaaaattcctgtaattcactcaaacgcttctgaagttcttctactggcagtttatcactcaacttttctttctttaattttaaataaacatctggtgctttaatcttatctttgatgttttcaaacccagcctgataactattcgaaagcagtttatcattgataaattttaaatcttctttctctgctttttctggactccattctccctcagtaattttgtccaagcatcgtcctattctgtccattactccctgatacaccgtagacgaaccaaaatattcaacaaatgccttaaaagccatatccgtccactttgcatcttctgcgaatttacgattaagccataatccctgtgcatcttctgtgattccataatccacatctcttcgagcacctgctgtttccaacaggtactccatccctacaattccagcgttcttcaaaaaatcgcccattgtaattacatagcgttccaccaaaccatcccctttctgaattaagaaaatttagaataaaacagaaaattttccatgtgcctcacttcgtctgcttcccagtcctgctgcatataataaatttaacagttccggatttccagttaacttataaattcctatgctttgatccgtataacgtgacatcacttttgaaaccaccttcttcccttttaacggagtaatagaaaaattgctgatatccatattaatattcagcttttctaaaaacactcttaaattttccttcaccatagaaggaaactctgcatcttcacaagtataataaatatctgtgttatcctctgaattgtgttttctcacaatcaaagaactctgcatttttataataatttcagtatctttaatttcttgaagattttgcgcttttattgctactaatttcatagaatttttattcatcgggtgtgatttattcttcatcaaactaaacgcattataaaactttaacagctccgccatattcgcatccgaaaacgatataaaaaatttatttccccttattcggattgtttcagttccaaatctggcttctggtaaaaaaaacgaccaactgtaggttttgattacagatttctttttcgtataaagctcctcaaaccactcggatgaataatttttgacagaagctttgaaaaaactcaaacctgtacggtccacctccaatggaagttctggattttcaacttcaaattctaggtttaattcggtcatagttgttttcctcttttcttttttccgaaaggactcttcttttttctcatagtaacactatgtttacaaaaaatcaatcatttttataattaatacaattttaatggtttaataaaataccaaaattaaagtcttcctttttttatctttttcgattacaatataggtgttacattttggaatgtaaatttaaatttgtaataatttatactttaaaatagtcccatattggaatgtacaaagaaaagattgcatttcgtaaattgaatgcaatcttttcttttgattttccctcacatttttcactatctccctcacacatatccatagattttttgctactactcattataatgaaactgatattaaaagtattttttattgggggaaaatcaatgaattcatctactataaaacgaatcattatgacttttgttggaatttttcttaccagcattagtgtttctatctttaaagcgtccctgtttggaactgacccattttcctgttttgcaattggaatctggaatgtttcccacataaaatacagtgtcgcttatataattctaaatgccgttcttttactcggtgtttttgtcttagataaacattatattggactcggaactttattaaatctgttttttgccggatatatcgtagaaaaaggtatgcagctttttgatttatatctgccacagagaactctgccagtccgtattttattactcgctattgcagttgttttagtgtgttttgcttcggccctttattttacggctgatatgggtgtctccacttacgatgcctgtgcactcatgattacaaaaaagacaaaactgccatttcgtgtatgccgaattggaacggaccttattgtcacaactctcggattctttatgggcgcaactgtcggcattggaacgcttgtcactgcatttggtatgggacctttaattgatttctttaaccgtacctgtgcaagaccgattctttatcacaaaacatcagaaatttcattattaaaacgctctgcaatgcattaagctttttacaccatatcaaaatccgtgtgcctcttttttaggagacacacggatttttttactctttttttgacattaccatttgactttttggtattatcagtggtagaatacataaaaaataaaggaacctcatatcctatatgctgcctgcgacatataccatacgatattcccttatcatttataaaacagcaaaacatagataggagactttttagaatgtttgaacaacaatttattaacttcatggaaaaatttgactctgtaccttttacaatcaaaacacaagatcacacctatcaaattggaaaaggagagcctacattttctgttttctttcacaaagtgccaagcatgtctgatttgcttaccagcacttctattgccctaggcgaagcgtatatgaacggtgatattgaaatcgagggtgatttatataatgccctaaacatgttcttaggtcagcttggaaaattttcaactgactctaaaaaattaaaacgccttatttttccttctctttctaaaaaaacacaaaaagaagaagtttcttcccactacgatatcggaaatgatttttataaattatggcttgatgatactttaagttattcctgcggatatttttccaaagatacagatactttatacgatgcgcagtgcaacaaagttgaccgaattttggagaaattatatttaaaagaaggaatgacgctctgtgatattggatgtggatggggcttcttattaattgaagccgccaaaaaataccatgttcacggtgtgggaatcacattgagccaggaacaaaagaaaaaatttgaggaacgaatccatgaagaacatttagaaaatctgctggaagttcatttacttgactatcgtgatcttccaaaatctaaaagaaaatttgaccgaattgtcagcgtcggtatgctggaacacgttggacgtggcaactatgaagaatttatgtcctgtgtaaaaagtgttttaaaaccgggcggattattccttctccactatatcagtgccctgcaggaacatcctggagatgcatggatcaaaaaatacattttcccgggcggagttattccaagtcttcgtgaaattattcagattgccggtgacatgcgtttttatacaattgatgtagaaagtctccgcagacactataataagacgcttcttgaatggaataaaaacttccaggctcatagagcagaagttgtagaaatgttcgatgaaaaatttgcccgtatgtgggaattgtatttatgcgcctgcgctgctactttccaaaatggcattattgatttgagccagattttatttaccaatgatgtgaataatgatttgccaatgacgagatggtattaaattttcaaaaaatccctaaagagaaatgctattctttctcttcagggatttctttttacttaaaaaacacagcatcatcataggtggtatcgtatatggtgtcaatcaatttattattttaattgcactatttatttatatttcacagccgttccataagcaatcacttctgctgctccagccataacctgtgaagaaccatatttcacaccgataaccgcatcggcatccatctcttttgcttcatccaccatacgcttcgttgcaatctgtcttgcttcgttgagcatttccgtataacctacgatttctccaccgacaagagttttcattcctgccataaaatctcttcccacattttttgtctgtacaacagttccttttacgattcccagcgcttcaaattccactcccggaatatattcaatacttagaagcttcatcttcttctcctccttcaatctctttcattctgcctgcaagtgcaatccaaagtccaattatcaatgccacaggtattgcaattaaaaataccaaaagcccaagtggtattgggtcctgcgaatttccccacagcataaatccaatggtaagtgccataagtacagtcataaccactgccccaatgattgcaccttttctttttttcttatgaacatccattttgtttacgttcataaactttgcaccctctttctccatctgttcaatttcttccagacattcttccgcatttagagtttccaaagattgatgttccgagatgaggcgttcacagatatcctgcattttcgtaagtccttctttgcgatattccagttcttttaaatgctgttcaaggcaaatctgcaggcttttcttcttttcaaaaagagctttcatttcttcaatagagagatccattttccgaaataacttaatttcctgaagtctggcaatatcttctttatgatattcccgatatccgttttctgcacgttccacatcaagaagtccctgtgattcataaaaacgaatattcttttttgtaatccctaccagttcttccacctgtttgattttcatttttattccgtcccttctcttccgacattttttgaaaatctgtctgcgttgtttctttgtctgtaccttgtttatacgacttccataaggtggaaggtcaagtattttttgagaaaattttgaaaaataaaacattccagtcagcgtacacttagaaatctatgcggtttcacattttacttcacacttttttacttctcataattgcaaaaatagaactaagcagaagtaacatcggataaaacaatttcggcataatctgaaatgcagaaatttctccacccagttcatttaccgctgaaattgccacaagcatctgcgcaccgtaaggaatgactccctgaaaaatacaggaaaacgtatccagaatcgaagctgtctttcttggagtaattccatattcctctgccatctcttttgcgattgggttcgccatgacaatcgctacggtattatttgccgttgcaatatccatcgttccaaccaaaagtcccattccaatctgaccgcctttttttcctcggaaaattttatgaatccagctaagcagagcatcaaatccaccatattctcgaattaacgcacacattgcagccactaaaatcgctaccatgcaggtttcaaacattccggatactccagaacccatgttggtaagtaaatcaaccggcgtcgtatgtccgcctatcagcataataaatgccccggaaacaatacctgtcaaaagcacgacaaatacattaattccaataattcctccaattaataccagtacataaggcaatacctgaaccagatgataagactggctgacatgcccctgaatttctgtctgaaaagataaaaccaaaatcaaaatcagtgttgctactgctgccggaaatgcaatccagaaattttcacggaatttatctttcatttcacagccctgtccattacaggcggcaatcgttgtatcagaaataaatgaaagattgtctccaaacattgctcctcccataacggacgccacacaaaatgccagattaaatcctgacgcctgcgaaactgctgccgcaatcggagtcaacaaagtaatcgttccaaccgaagttcccattgccactgatacaaaacaggcaactacaaataatacggctactgagaaccttgccggaatcagactcaacataaaatatgccacactctccgcactgcttcttccgacaacaccgacaaaagaacctgctgccagaaaaatcaaaagcatcgtgataatatttttatctccgactccctgtgccataacttccagtttcttatcaaaactcaactcccgattttgcagacatgctacaagaattgcagcaagaaatgcaactacaatcggcacattataaaatcccatcggaattttcatcacatactcaaataaaattccaagaccgagatataatacaagaaatacaccgattggcaataacgcaattccttttccttttttcatctactctctccttctcttttttcttaatcttgtcttattgtaccacatcaaagaaaactcttcagcaaaaaaagaaaaacccatagaacaaaaattctacaggttttccaaatttatacaaaatctatttttctactccctactgctttctctcttctctctgcacctgagcgtctgatacttgcaaaaatcgaaccggaaatattatgccatacactaaaaattgctcccggaagtgttgccagtggatttcctgcaaaatttgcagcagcaagtgacaccgcaagtccactgttctgcattcccacttcaattgcaatcgcagtcgttcttgagtattccacatgaaaaatctttgcgacaagaagtccaagcatcattccaaagaaattatgaattgccactacaacaagtacaagcactccacagcttaagattttctctgcatttaccgctacgattcctccaataatcattacaatagcgataacagaaataagcggcataacatcagacaccttatctacatgctcccctgcaagacttctcagtaaaattccaagcaataccggcacaagaataactttaatcacggacaataccattgcccagaaagaaacttctacccatgctcctgccagtacatagaccagaaatggtgtcataagcggtgctgccagagtggacacaatcgtcattcccacagaaagtgccacatctccccctgcaatataggtaatgacattgcttgctgttccgcccgggcagcagcccaccaaaattactcccaatgccaaatctgccggaagatgcatcactttgcaaagcacccatgcagccagtggcataatggtatactgcgctaccgcaccaataatcacttcttttggtctggaaaataccactttgaaatcattcatccgtatcgtaagacccattccaaacataatgacgcctaaaaatactgatgtataatttgtcatccatgcaaatccatcccgccagaaaaatgcaaggcaggaaaatgcaataataataattccaatatatctggatgcaaaactactgacttttccgattttatttaaaatatttttcatgcattatacctcgtagctgaagttgtcaatcaatctggtttttccaatatatactgccattgctacgagtacatttttgtcaattttttctaccggctgcattgtcagtgcatctacaacagaaacatagtcaatttttgaaagtggttctgcttcaattactgcacgcatctttccaagaagttcttctgccatcattcctgtctgaataatttcctgccctgcttttactgctcttgacaaacaaagagctgcttttctttcctctttacttaaataagtatttctggaagattttgcaagtccgtcctcttcacggataatcgggcagcccacaatttcaatgtcaaaatttaaatcttctaccattttgcggataattgccagctgctgtgcatctttctgtccgaaatatgccttgtccggtgctacgatatgaaataattttgacacaaccgtgcaaacacctttaaaatgaattggtctggtttttccacaaagggtttcagataatgtatcgatacttacaaaagcatgcgggtcatggtacatttccgatggttccggacagaaaatcatatctgcaccaaggctttcacaaagtttactgtcacgctcaaaatctcttgggtatgcctctaaatcttctgtcggtccaaactgggttggatttacaaaatctgatacaactacgatatcattttcttctctgcattttttaatcagacttgcatgtccctcatgaagaaatcccattgtcggaacaagtcccacggtctttccttcttttttccatgctttaatttgttttcttgtttcttctactgtttttgttacctgcatagtttgctcctctttcttcagttacatttcactgatgtcctgattttataaactcagagatagcctcttttctgaaattcactttcctcttacttgcaatactgttaatcctattgcttctgctgacttctcagccttactcttccatgtcttttaataagccatgtttctcataattggttactctactgattttattctcttcatttacaaatacaactgcaggtttatgtgtacgtgcctcttccggctcatactgtgcatatgccatgataataatcttatcacctgtacttacacatcttgctgctgctccattcagacagatcataccgctcccgcgttccccgcttatggtgtatgtctcgaatctgctgccattgtttacatctacaatctggactttttcatattccagtatgtttgcagcttcaagcagttcttcatccacagtaatacttcctacatagtccagttccgcctgaacaacggttgctctgtggatttttccttttaacatttctattgtcatcttatataatcctttcccataaggaaataaaaaaagcatttaaggacgcactccgaccccaaacacttctgattgatttcctgtatatccgagtcctgttttccttaaatacacaatacaggctcttatctttttatacttttgacatttacgtcataaattataaattctatataagattccagtgatttcagccagagtatagttttgagttcaaatactatctctggcgttattatcacatttaaagatttgtttgtcaagaggttcatttaggacgatagccccacaagtctacacagctagttgtaattccagaaaagccttctttaataataaaaatctcctgttcttctgattcatcaggagtatgttcagaatcagggttcatggaataagttggccagacttctttttttaagcaaaaaaatatgcgactaaaaaactatagttttcactataattctttaatcgcattccattcaccatacaatttattattttgttgttgtagagttttacaactctattatgattatgtacagataataccattttatttcatattagtcaattattctttatttatttattttttttgtgaacatttcacatttttctaattttacatttagcatttattacagatagctttagataaatttgaatgattatctccacactcctatcgttttttcaaaaaaatcttgaattgcctgctcatgttgtggatgaaaaatttcgggcagatttctttcgtcaaaaaatttcacctctacggtttcttcttgatctattttcacttctccgccaaccatctttcctctaaaaaaaatactacacatctgaatagtatcaccattttcgtatttatgaaaatatttgctgtaaactcctagcatatctataatagcaacatctactcctgtttcttcatgtacttctctgattgccgcctcttcagcagactctccgtaatctaacattcccccaggtattccccatttatttgaatctgatcttttttgcaataaaatttctcctgctttattctgtataattacacctgctgccattaacataattggcatgttccctactttatctcttaacattttccaatattccatacttgttctccttttatcttgcacaaataaaaagatgcgattaacaaacagtttcctcaactgtttttcttaatcgcatcttgtactcttcgcctaaaaatattttgttgttttttcttaacttaaattataacttcttatttaactgattgcaatattttcttttagaaaaagtcagggctttttttacgaaaactcagtttcagtattttattttttgaactaggtattttgcccaatcaaccttttttagttacaacacactaataatctacattttcggctgatatctcatattcgatacattatataccgtcacaaatgcttttggatcttctcgattaataaagttcatcaatttttgatattctgtcttatctacaattgtgataatttcatttcttttttgcatcttatatgcaccggtcgcctcgtagatagttgctccactatgcaaatcttcaataataaatctacgtaactcttcttctttgtttgtaatcacacaaactcgacgcttgatattatgatcaaagataaaatgatctaacaccattccattaaaataagttcccagaatacttaaaactactgtttttttatcatacactaacgcagctgaaagtgctacgcacattccggataaagacattgcccttccaagttccatattcagatacttattcataatttttgctacaatatcaagtccaccggaagaggcatttcgattaaataaaatgctaagtcctatgcttaccactaaaatataacaaaggacatctaattcctgactattggtcatcgaaccgaaatttggcgcaattttttcaaacaagccaataaacagcggtaagacaacactggtataaaccgtctttgctccaaattctcgaccacaagtgaaaaagccaattatcaagagcactacatttaaaatcattgtaatggcagataacggcaatggcacaaagtttgatattacaattccaagaccggaaatactactcactgaggtgtgacttggcactaaaaagaaataaaccgctgctgcaataatggcaactgcccaggttaaaatgatgatttcttttataaaatttttgtaatttaatttttctttcatagcttctttgttcctccaataatcaaaactcgaatcctcaaaataatacccaacagaaaaaccccggaaaccttatggttccggagtatcttacgtttgggcacaacattatcttgcgataacagatctatattcagtagtcgactaaactcaaactgcgtcttatgacttgctttcgttaagttctctgcctaattactcgatgattatagcaacacgacctgctcctacaatacgtccaccttcacgtttgtgaggttcttaaaatctcattattttctgtgattttcgtgtctttattgtcctgtgttataggatttctacgctatatttctgttctcttcattttttagtatcaaaacggtatcacagccagattttcatgagctgtcaactttccggttgcagattcccaccttgactgttataatcgaaacatgggtgctatcataacggtaggcggttagtccttcagcagagggactgtgaccctctgattacatagaaactcgaaagagaatccactggaaaggagggctaagccaatgagtattgtggactttattgcagtcgtgagcttcggcatcacctgcttttgtgccggatacacattcggcaaagataataacaagacacaaaaataaccgccccagcctcgcaaactgaacggttatttttaatcaattaagtatgtggactaaccgtctatcggtagcactctttttctataatcatattagcacgcatgtgtgaaaatgtcaaaaaatttcttcattcttggttattaatctccttgatcaactgtactgccttctctgcatcatcggttttcacgaatatatccacaccatatattccaaatcctggtgccccatgcattgcaacattcgcacctgcttcctgcgaaaaagctgctattccattttgctttaacatttctacaagttgttctgtctctactatattctgtgcattataaatttttgtccattctgccttagatatggaagtttcctttttctcctgaatatttgacgaattctggtttctttttcgattaataaatgccaagagcctaagaacaataaatgccacaatagtaataccaatcagaaatcccaatgctaattgtgttacctgtgtttctgtagctcccattctaaataaacatatgccatagatgactgtaaaaattcctgtacatatcacactggtgagaaaatctcgccatatagtagcactttttggcaaacatttatcccatattccattatacaccataatagaggcgtacaggattcctcctaccaaagcagttgctgtctctcctaaaaccaagcgaatatccacagttaataacatctgaataataatcgctaacacgctaatcacaaacattgatgcaaatgcaagatttccagcctttaatgctttttgtttcacccatccttcatacaccacaactttgtccagtgtttctttcatctctttattcatagtctggctcctttctccatccaggagctctctcatctcaacatcgtaatattcagcaagttgaacaagtatactgagatctggcatatttattcctgtttcccatctggaaactgttcttgcagatacctcaaacttctcggcaagctgctcttgcgtaagattcttttctttacgacattgctttaaaaaagctccaatcttttttgtgtccatgtctctacctctcttccacttacagcttaccaatatgtatcaaaattaccacgacataaaacgagaatccgctaattttcaaccggacatcgtatgtctaaaacaaataaacggtattttcaccccaaaagcattctattcctctataaattaaccttctcttttatgtctatccataagtagcagaataaacataacaaaccatatcacccatgcaattaaacaaccgattcctatatgccaaatatctataatcattccagcaataaaaggaattgacataaacatcattctcttcccatatgccttacacatagcattttcatcatatttttttcgttcttctgctgatttcatattataaccagacaagaatttggatgcttgtccttttgacctataaaaccatattccaaataaaagcataatcactgccattgcaaagtcaaaaataatataaatatagaacatataatgccttcctttcagtcaattcctcaaaccagaaattattactttttgcatagtgtgttttctaaaatgataataaccacgacatcaactacaatgattcccaatgcaatatatacaaaaaatgcaggcaaaatattttcaagcaagcccataattaatacaagaattgctataatagacattccaactcccattgtcctgcataacttcttttcatcatattttttcttttcttcttttgaagctgtattatatccagaaataaaccagcttccgtgtccagaaagtaaaactatagaaagtacagcaaatattacaaagacaatccacactatccaatcagaacctgttgctaaatctgctaatttcaattatagacccctccctaaattccgtttttcttaattctaaaaatctgaaagttgtcttttaagatttcaatttcgttaaatcctctaaatacatttctgtataaccacattctgggcagactgcaactctaacatcatctatagttgtcgccttttgtttttcatctacacgaacaaccatcccatagccaccgccattaactttaagtcttaaatctaatttcatacttgctccacacttttcacatttcctcattgtttatacctccaaatcccgaatttgagaaaaagcccaaaggacttttaatgtcccttatgcttttctcttttctttcgctgttttagttcaaacattcgctgttcttccgcctcttttttctttcgttttttttctttacgctcctgtttgttctgttcctgttgtaatttcaacgcctgttgcgattttgtgccaatgccagtttccagcatctgcttttttgctgaacgctgcatccgtttcggatttctttttatatcctttacaatagcttcaacagccggactgaatttcaaaccgaaatagtatttttgaatatattcctgcacttcataatcttttggttctacgccaaatgttacctttgccacagataatttaccatcttcaatatgctcaaatatgcctacccaaaatggttcttcaaaatataccgtcaatcttccatttactctgtccataaaaatccctcctaaaatttattgaacaaagaatggacaacccggaggggcaggttacttaccctatttatataggacggccgggctacctaccggctctggcacatcaaagatgcacgttgcgtttttatctttgttttgataagtttcaatttaccttcactttattttaccatagtgctttctaaagttctattctaatatacaaaaatgtaaaaaagcgattttatccccctcgcaatcacacatatatcatgtttttcaatacaatttcttctgcactagcttttatattattcatcagcctgacccactccatctgatcctgtgcctttaattcttcagttacaccctgtttttctgtcatctgttccataagcgtttccacctgttctctagcttcctgatcagtctgattcagatgttcattcagctttccaatcaataacaaatactgataccttgctgatctgtgttcttttaagaactgctttcgtaacattccatattttccatatgtcggctcttcttctcttaaaaccagatccggcaaatagtaatctccatgcaatgtatagctcattccatttttttcatcataaaattgttttttcatagtctaaatctccaatcctttgtattttgttctatttttcttacgttgttggttttcaatctgactcttttgagtcgcccattccaactgtttcagaacgcttccctttggcatttgctccattcgccgtttttcttccagtgtcctctgttctttaatatcctgctgcaccacatcctctacagtttctgatcccaaaatacgcaccactctgtcatatctgtccgaaatctcttgtaaacgttgattatcatttaataattccccattttctttacgcacatcatctaactgcgtttggatatcatcacatttctccgtagatttttgatatttgtttttccagctttctatcgttttgttaagttctacaacctttccagctaatgcagcaatctgattcttcatcttgataaacaatggcttgattttattttctctgtaaggtactgcacgttcaaatgttcctgcctccggtaaaaacgtcttaatcattccatattcttttatttctttactggcattatccataatcggctgcagcacatctcgacgctcttccagactttttacttctttttctgcgtcctctgccctttgttctgcttcttgtttctccctgattgcctgttccttatcgtcttttaaaatctggatatctgctctgaattccgcaatttgtgctgtcagttcttcgttttctgcagttagatactctttctcctgctccagctcctgtacttccttttttcgctctttcttcttgaagttataaacatccaaatgttcctcatgagtacctttctgttcccattcaatgccatgctgttttgcaatctctgccaggacctttttttcatggttcatccactggttcaactctgtatcatgcttatttccaccttgaaatccaagactttttaatgcctgtttcaatgaaactctggtgtccattccttttcctttccaatcagtcacataaggaataaaatcaatatgtaaatgtggagtagactcatcctgatgtagataacacccaaatacccgtagcgctggattccgtttctggaagtcctttacatattcatccagcacttttacagccagatctccttctactgttccgacagccatatcttcacgatttccaatctggaaaatcacttcgtggaacagcttttcctgctttccctgacggattttttcatagtaatttataatctgccgatcctttctttttcccacattataccgttctacagaatcatcaaacaactctttatatacttctttcagattttcattctggtaacggatattcaggtgtactctgtccggatctacattttcagctataaaatcccgtctgttatgagctagggaaccagctccaatcatgccgcttattgtcctttttattgtcatattccttcacctccccttctaaaagcagtgccagatattgcatataatctttatttacgccagccatggcaattataagaaatcttcgccggatacggcggttttgttacttttgtcaaaagtaacgcaaaagcactttcgacagccgtaccgtccatcaaaagtaaccttgcgccctgccgggggctatttctcctgcggtatgtatccgcatatcctattccggtattctcgcccggatatattccagatcaccacagtacggtgttcctaccagataccattcccttgccggattcatctccattctggtctgcacccactgatcatcaattagtacttccaggcattctccacaatgaaatcctgtatcaatccataaatctgatgacaataaaccatatctgtcgttactgctgttataacctaatcttccttctctcattgctgtatgctcctttctattgtcctgctgtaagcacgctctgctttagggctccctttcgcaacctataatttgtctataaataatcgggtaatctataacctctcgtctgcacattacagactttcccttgtctgatatttacaggtgcgtgacacgctcctgttatagagtaatcaacaagaagttttaccatcgaaagctttccggtattccctttttttccagatattcctgccggtacttttctctttcttcctctgttgctgctgttttgtacttgctgtataattctcgatttatcattgtatccagctttttttccaatcctttttttatatcatcctcttcctgtttctgatccagtaaatgatattttaaaagttttccaaacaactcctctggaaccataacgtttttcattttctcaccttcttacttttcagataaggacgcaacactgcaatgtctttacagattgcaaccttgcattttaattccgcattttctatatactctgcaatgttgcacccttaatttattccggcttaactttatttaaatcccaataccaggaattaccgattcgtcttgccttaattccaagttccttttttgcattttccagtgttcttttagaaatattcaaatcttctgccatatcaaagatttcactgctttgcacagaagttgatgtttctgccagttccctcagcatcttttttgcctgttccagtttatttacctttggagcaattccaccaagcacctcatctgctgtgatttcatagtcacctatccactcaaatccggtttctgtcaggcgaaatgctttggaatgtccaaatgcagccagattatttttaatctgaaccactgctcttaagtccggttctccctctattcttcctaccagtaatacgcttctggctactgcaaaaaagtcaatcgaacccattcctctatatgcagctttatttccaccagctttattcatatgtccgattaataaaattgcacatttatacttttctgccagcaagctcaatctttttgtcatatcccttgcttcatttgcccggttcatatccattgttcctccaaggtatgcctgaatcggatctaaaataagcactctcgcaccagtccgtttgatagcagtttccagtctctcatctatcatggaaagtgatttttctgtttcatctataaccatgattctttcacagaccgcttctgccagctccagtctgggttttaccgtatctgccagcccatcttccgctgtctgataaataatctttactggttctgttactttcatatcgttatccagaccttctcctttagacaatctcgctgcaatatttaatatcagcgtagtttttccatcgcccggatcaccctgaatgatcgttaatttcccataagggataaatggataccagagccagtccactgtctgggactggacatctgacatctttatcattttcaattctgttttattctcatttctctgttccataaattcctccatttttcaaactattctcgccaattatctgttgttctctggaagaatccctgatataatcaacttgtctagggttgacatttgtggattcgtccccatttgtcacattgctccggttgttcgtacttccggagctttttatattttcatcatccagcatatctgccaccactttctgctgatctggatataagtgcccataagtattcaatgtaatgcgaatgtccgtatgtccaaacctttctttaatcatcaatggttgcactcccttattgatcagaaatgccgcatgactgtgacgaatgtcgtgtactcttatcttttttactccggtcttttgaaccacctgttttaacttatgctgtaccgcttcatgaaccattggaaaaatccgttcatcttcgggcaactcatacagtctgctaatatagtcctgaatctcttttttcagaaattccggtatggaaatcgtacggttcgattcttctgttttgggagatgtaatcacgtcctctccatgcatacggtagtaagttttattgatatgaagtagattcttttcaaaatcaatgtcagcaggtgtaatgctgagtgcttcgccttctctcgctcctgtccagaataataattcaaacagcacataatatttgcttcccggttctattccggtcataaactgccgatattcttcaattgtccaaaacttcattttcttttttgaagtctttcccatacgttttactttgtcacaaggattatctgccagattgtagatattcttcgcatgattaaacaatgccgtcatctgattctgtattgttttcagataatcatctgaatatcctttttcaataatcgtattctgccactggataatctctgctggtgtgatactgttcatcggtctgtccttaaaatacggtaacagttgagcattcatcgtatctcttttgttcttgatactcctgtccttcaatgactgagacttgtctcggaagtagacttctacaaactctcccattgtcatatccatgtctgctttcgctgttcttttatactccgcttcaaaatttaatgcttctttcttagtgcggaatcctctttttacttttcgctttttggctcctgtccagtcctcataataaaatgaaacataccaggttcctctttcttcatctttgtatgctgccatactttctcacccccttacattgcaatctgggaatatccataaaatttcttttcccagaatgccctcggtatcttgcccgcaacggttacatatccctgatctgcaagctctttgttcagtttgcgaagcagcttgtaagcatatccaagtgaaatccccatgctctctgcaacttcttccgctgtaatcatatagttctgtctctgcatatcatttcctccttgtctataattatcattttcactgatactatatcattttaaataatcattgtcaataatttttatcatcatgaatgatatttttctatattgttgatttttatcatttgtgatatactaatcatagcttttaaggaggtggataatatgcaggaatcatctatttcagaaaaaataaaagagctgcgaactgatctgaagatgaatcaaaaaaacttttccgcagctattggtatacgtcagtcaactttatccagttatgaaaatggtgtggttactccctccaatgatgtgttattgactattgctcagaaatttcatgtctcactggactggttatttggattatctgaaaataaagtacagatttctactctcagcgatattctttgggttttactgcagatgaatgaatccaatgaactccggtatgaactggatataaataataaacttcccggtgatatagaaacagaaacacagaaatggtatgccggacttcgcttttatggaaatgatcctgaacattctttaaacgcagatatgtgtaattttcttgctgatctgcaggagaacagagaaagcctggaatcttatttcacaggcaaagatatgtttgatatgtggaaaaagcagacgttggaatactacacttccaaacctgtcacccataaagaaattgaagaactggattttgagacacgaatccgtaaacgagatgaacttttaacacagaaattttccaataacgaacagaaatagtatcataacagtatcacaggcagatatgcgaagattttcattttcttcccatacctgcctgtttttaatttattcgctattctttacagccttattttaaactttttactcaacagaaaaaccccggaaaccttacggttccggggtatcttacgtttggacacatgtaccttgcggtactcaatatatattagtcagtgattactcgatgattgtagcaacacgtcctgatcctacagtacgtccaccttcacggatagcgaatgtaagaccctggctcatagcgattgggtgaatcagttcgattgtcatttctacgttatcaccaggcatgcacatttctgtaccttctggtaagttacaaacacctgttacgtctgttgttctgaagtagaactgtggacgatagttgttgaagaacggtgtatgacgaccaccttcatcttttgtcagaacgtaaacctgagctgtgaattttgtatggcatgtgattgttcctggtttagcaagaacctgtcctctttcgatttcgtttctctgaacaccacgaagaagtgcaccgatgttatcaccagcctgagcttcgtctaacagtttacggaacatttcgataccagttacaacaactttacgtgtttcttctttcagaccaacgatttcaacttcttcagatacgtgaagaacaccagcttctactctaccagtagcaactgtaccacgacctgtgatagagaatacgtcttctacaggcatgatgaatggtttgtctgtgtcacgctgtgggtctggaatgtagctatctacagcatccataagttccatgattttgtcgccccattcgcttgctggatcttccagagctttcagagcagaacctttgatgattggagtatcatcgcctgggaaatcatattcgtctaacagttcacgaacttccatttctaccagttcaagaagttcttcgtcatcaaccatatcacatttgttcaggaatacaacgatgtaaggaacacctacctgacgagacagaaggatatgttcttttgtctgagccataacaccatcagttgcagctacaactaagatagcaccatccatctgagcagcacctgtgatcatgtttttaacgtaatcggcatgtcctgggcagtcaacgtgtgcatagtgacgatgttctgtttcatattcaacgtgtgctgtagaaattgtgataccacgttctctttcttctggagctttatcaatgttctcgaaatctgtagctgagttaccagcaactctttcagccagaacttttgtgattgcagctgttaatgttgttttaccatggtcaacgtgtccgatggtaccaatgttacaatgcggtttgcttctttcaaatttagcttttgccattttgaatgtcctccttgtttatgcgccccgtacgggcaatttttgtttgcttactgcctcattacgagacgtcggaatataccaatattatattaaaatatattcaacctgctatccttgattatattgcaaatcaaggatatttgcaagtttttttatcaataaatacgactgattattttgtagctttaccagcgagtactttttcctgtacggattttggtactggctcgtatttttcaaagaacatggagtagttaccacgaccctgtgttctggaacgcaggtctgttgcatatccgaacatttcggaaagcggaacatatccacgaatcattttaccaccgccgatatcgtccataccttcgatacgtccacgacgagagttaatatcaccaataacatcacccatgtaatcttccggtgttgttacttcgactttcatgattggctcaagaagcactggtgctgctttctgcatagcatctttgaatgctaaagaaccagcaatgtggaatgccatttcagaggagtcgacttcatggtaagaaccatcgtatacatttgcatgtacaccaacaactgggaatcctccaaggataccagctttcatagcttcttcgataccttcgcctactgccgggatgtattccttcggaatagcaccaccaacaactgtggattcaaacttgtacagttcttcaccgttggcatccataggctcgaatttaactttacagtgaccgtactgaccacgtccaccggactgttttgcatatttgctgtcaacgtcaactgcttttgtgatggtttctttgtaagcaacctgaggagcaccaacgttagcttctactttgaattcacgaagcagacggtcaacgatgatatccagatgaagctcacccataccagcgataattgtctgaccagtttcctgatctgtatgagcacggaatgtcgggtcttcttcagcaagttttactaaagcttcacccagtttaccctgaccagcttttgtcttaggctcgatagcaagctcgataactggttctgggaattccatggattccaggattaccggatgctgttcatcacagattgtatcacctgttgttgtgtttttgaaaccaacagcagctgcgatatcacctgaataaactttatcaagttcctgtctcttgttagcgtgcatctgaaggatacgaccaacacgctcttttttaccttttgtagcgttcagtacgtaagaaccggagttcattgtacctgaatatacacggaagaatgcaagcttaccaacgaatgggtcagccataatcttgaatgctaaagctgagaatggttcttcatcagaagaatgtctctcaatttcatttccgtccatatcaacacccttgatagccgggatgtctgtaggagctggcatgaattcaagaattgcatccagtaatttctgaacacctttgtttctgtatgcagaaccacagcaaaccggaacagctgcacattcacatgtaccttttctcagagctgcttttaatgcatcgatagaaggttcttcaccttcaaggtattccatcattaaatcatcgtctaattcacagattttttcgatgagttctgtatgatacagttctgcatcttcctgcatatcttcaggaatgtctgtgattgtgatatcctcacccttatcatcattgtagatgtaagctttcatttcgaataagtcgatgattcctttgaactcgtcttctttaccgattggtaactgaaggcaaattgcgtttttacctaaacgagtcttaatctgatctactgcattgtagaagtttgcacctaagatatccatcttattgatgaatgccatacgtggtacattgtaggtatctgcctgacgccatacattttcagactgaggctcaacgccgccttttgcacagaatacaccaactgcaccgtcaagtacacgtaaggaacgttcaacttctactgtgaagtctacgtgtcctggagtatcaatgatattgatacgatgttccagtgcacctggttttgctttacagttttcctgtaaagtccagtgacaagttgttgcggctgaagtaattgtgatacctctttcctgttcctgttccatccagtccatggtagcagtaccttcatgagtatcaccgattttatagttaacaccggtatagtataagatacgctctgtaagagtagtcttaccggcatcgatatgtgccataataccaatgtttctggttctctctaacggatattctcttccagccaatggattttcctcctattgaattagaatcgatagtgagcaaatgctttatttgcctcagccatcttatgcatgtcttctttcttcttaacagatgcgcctgtattgttcattgcatctaataattcatttgccagtctgtcttccattgttttctctcctcttttacgagagtagagagtaatccagcgaagagctaaagcctgacgtctttccggtctaacctcgattggtacctgatatgttgcaccaccgatacgtcttgcttttacttccagaacaggcataatgttgttcattgcttcttcgaatacttcgattgccggttttccggctttttcctcacatttagcgaatgcaccgtatacgattttctgagcaacacctttcttaccatctaacataatgttattgataagttttgttaccactttgtttccgtataacgggtcagctaaaacgtctcttttctgagtatgtcctttacgtggcacgttacttccctccttaatcattttcattgttaatagacaaatgacattgtcccaaagattaaatcatcggtactcacacaactataagcgtatgtccgtacgcggtaaattctctatataaacccgcagccactccgttgggcttatggaatccccgtacaaaatcaatagttatatctgtgatttcaaatgataatttctactataataaatcaagcggaaatttttaccgcctggccgaatttattattttttcggtcttttagcaccgtatttagaacgggcctgacgtctgtttgcaacgcctgcggtatctaatgtaccacggatgatgtggtatcttgtacctggtaagtcttttactctaccaccacggataagaacaacgctatgttcctgtaagttatgtccttcacctgggatatagcttgttacctcgattccgtttgagagacgaactctggcgatttttctaagagcagagttcggttttttaggtgtagcagttttaaccgctgtacacacacctcttttctgtggagaagacatatctgttgtcttcttctgtaaagagttgaagctcttctgcagtgccggagctgtagactttttaacggaagtctgacgtccttttcttactaactgattgaatgttggcattcctttcacctcctgtattatttttcttctgccatattatatagaagaaataagtggctgccagttattcattcttatgaataaactttttttatcgcgcacaaaaaatacgcagtcctgtgcacgcctcctcattatatctgtggaaaaagttgctgtcaaggtatttttttgttttttttatttttctttcaaaaatccgaccctcacactcatttatccgtctatgaaagagaaaaacaaaagactattttgccagttatctgacaaaacagtcttttgcatttattttcttactactcttactcttctgttaattctgcttcttcttcctcttcggaaagttctacttcatcaacagcatctgtaagtgtttcttctgtatcctctgtggtttcctcaccaactgttacgtcttcattttcttccatttcgtcaaactcaacttcttcttcatcagtatcaagcttaatattggaatactgtttcatacctgtaccagccggaatcagtttaccaatgataacattttctttcagaccaatcaacgggtcaatcttacctttgattgctgcttctgtcagaacttttgttgtttcctggaaggaagctgctgacaggaaggagtttgtagcaagagatgcttttgtaataccaagcataacctgttttccttctgccggttctttgccttcttcaatcagtctttcgttctcttcttcaaagtcaagaacgtcaactaatgttcccggaaggaattctgtatctccgttatcttcgatacgaatcttcttcagcatctgacgaacgataacttcgatatgtttatcattgatttctacaccctgcagacgatatactcgctgtacttcctgaatcatgtaatcctgaacggcacgtactcctttaatcttcagaatatcatgtggatttacagaaccttctgtcagttcatcacctgcttcaagtacctgtccatcctgaatcttaatacgggagccataaggaatcaggtaagtcttggagtttccatcttcgttgtctgtaacaatgatttcacgtttcttcttggtatctttaatggtagcaatacctttgatttctgtgataatcgcaagaccttttggctttcttgcttcaaaaagctcctcgacacgaggaagaccctgtgtaatatctccaccggcaacaccaccgttatggaaggtacgcatggtcagctgtgtaccaggttcaccgatagactgagcagcaatgatacctacagattcaccaacctgtactgcttcacctgttgccatgtttgcaccatagcattttgcgcagacaccaatatgacatttacaggtaagaatggtacggatttttactgcatcgtagccagttccatctgcttttacaccgtcatttacgattcttgcagcacgttttggtgtaatcatatgatttgcttttacgattacttcaccatttttatctttaattgtctcacaggagaaacgacctgtgatacgttcctgaagactttcgatttcttctcttccatccatgaaggcttttacccacatacccggaatttcgtttctgttttcactacagtcaacttcacgaacgattaagtcctgagaaacatctaccagacgtcttgtcaggtaaccggaatcggctgtacgaagagcagtatcggacataccttttcgagccccatgcgctgacatgaagtattccagtacatcaagaccttcacggaagtttgatttgataggcaactcgattgtatgaccggttgtatcagccatcagaccacgcataccggcaagctgtttaatctgcttgtcagaaccacgggctccggagtcagccatcataaagatgttgttgtacttatccagaccggacagcagtacacgtgtcagctcatcatcggtctttttccatgtttcaacaacttctttgtatctttcttcttctgtgataagaccacgtttgaagttctttgtaattaagtctacggtatcctgtgctttctgaatcatttccggtttctgaggcggcacagtcatatcagaaattgatacggtcatcgcagctcttgttgaatatttataaccggttgctttaatcttatccagcacttctgctgttcttgtagcaccgtgtgtattgataactttttcaagaatctgttttaactgtttcttacctaccaggaagtcaacttccggttttaattcatttcccggaattgtacggtctacaaaacctaaatcctgaggaatgatttcattaaataagaaacgtccaagtgtagattctactgtaccggaaagaacagttccatccggcattgttttttccatgtgtacatggatttttgtctgaagcgtaataacctggttttcataagccagaattgcttcgtttacgctcttgaagtattttccttctcccttaacaccaggtctttcctgtgtcagataataaataccaagaaccatatcctgtgaaggaacggctaccggaccaccatcggatggttttaacaggttgtttggtgagagaagcaggaaacggcactctgcctgtgcttcaacggacagtggaagatgaaccgccatctggtcaccatcgaaatcggcgttgaatgcagtacaaacaagcggatgtagcttgatagccttaccttctacaaggattggctcgaatgcctgaataccaagacggtgcagtgtaggggcacggtttaacataaccggatgctctttaattacttcttcgagaacgtcccatacttccgggtcgagtttctctaccatctttttcgcatttttaatattatgtgcatttccgttgcttaccagttctttcataacgaaaggtttaaacagctcgattgccatttcttttggcagaccacactgataaatcttcagttccggtcctacaacgataactgaacgtcctgagtagtcaacacgtttacccagaaggttctgacggaaacgtcctgatttacctttgagcatatcagaaagggatttcaatgctctgtttccaggtcctgttaccggacgaccacgacgtccattatcaatcagagcatcgactgcttcctgtaacattctcttttcattacgaacgataatgtcaggagctccgagttcaagcagtcttttcagacggttattacggttgataattcttctgtacaggtcatttaaatcagatgttgcaaaacgtccgccgtcaagctgaaccattggacgtaagtctggcggaataaccggaacaactgtcataatcatccattccggacgatttcctgattctttaaatgcttctacaacttcaagacgttttacgatacgtgcacgtttctgacctgttgaatcttttaaacctgcttttaattctgctgattctttttcaaggtcaattgcttcaagcagttctttgatggattctgcacccatacctacacggaatgcagaataaccatattttgcacaagcttcctgatactctttttctgtcagtatctgtttatactgaagctctgtttttcctgcatcaagaacgatgtagcttgcaaaatacagaactttttccagagaccttggtgaaaggtcaagaatcagccccattctggatgggattcccttgaagtaccagatatgggataccggagctgcaagctcgatatgtcccatacgttcacgacgtacacttgcttttgtaacttcaacgccgcatcggtcacaaacaacgcctttatagcgaattttcttatatttaccgcaatgacattcccagtctttgcttggtccaaagattttctcgcagaaaagaccgtctttttccggtttcaaggttctataattaatagtttccggttttttaacctcgcctcttgaccattcccgaattttttcaggggatgccaaaccgattttaatagcatcaaaggtcattggctggtatacctctttatttgctgtttctggcattgtggactcctttccttactcttccagagtatcctcatctacgctcagtaaatcatcgtcattgtcttcttcttccacatcgactaattcttcaccttcaaattcctgtttctggaatccgtagttgccgtaatcttcgtcatctctgtggtgtctggaatcaccttcgataatagaacgcatatcagtctcgccataatcgatattttccatgatttccacttctgtcatatcatcttttaagactctgacatccagacccaaggactgtaattctttgagaagtactttgaatgattccggaataccaggctccggaatattctcgcccttaataatcgcttcataagtcttaacacgtccgattacatcatcggattttacagtcagaatttcctgcagagtataggaagcaccataagcttcaagtgcccaaacctccatctctccgaaacgctgaccaccaaactgagctttaccacccagcggctgctgtgttaccagtgagtatggaccggtagaacgtgcatgaatcttatcgtctaccaggtgatgcagtttcaggtaatgcatgtgtccgattgttacagggctgtcgaagtattcacctgtacgaccgtcacgaagtcttactttaccatcactggaaatcggaacacctttccacagttttctgtgttctctgttgtctgacagatactgcattacttccggatttaatgtatctttatgttttgcctcaaactcatcccattccatgtttacatagtcatttgcaagtctgagggtatcctgaatatcaacctcgtttgcaccgtcgaataccggtgttgcaatgttaaatccaagtgcttttgccgcaagacttaaatgaatctcgaggacctgtccgatattcattcgggaaggtacacccagaggattcagtacgatatccagcggacgaccgtttggtaagaatggcatatcttctacaggaaggacacgggaaacaacacccttgttaccgtgacgtccggccatcttatcaccaacggaaatttttctcttctgagcaatataaatacgtactgcctgatttacaccaggagacagttcgtcaccattttctcttgtaaatacttttgcatctacgataataccgtattcaccatgcggtacttttaaggaagtatcacgaacttcacgtgctttttcaccgaaaatcgcacgaagcagcctttcttctgctgtcagttctgtttctccttttggagttactttaccaacaagaatatctccggcacgtacttctgcaccgatacggatgataccacgttcatccaaatcttttaatgcatcatcaccaacgcctggaacgtctcttgtgatttcttccggtccgagttttgtatctctggcttctgcttcatattcttcgatatgaacagaagtataaacgtcatcctgaaccagtctttcactaagcagaacggcatcctcgtagttataaccttcccaggtcatgaatccgattaatggattcttacctaatgcaagttcaccatttgatgtagaagggccatctgcaataacctgtccggcttctactctctcacctttgaacacaatcggtctctggttgtaacagttactctggttactacgcataaattttgtcagatgataaacgtctttctttccatcatctgtacggataatgatttctttggaagctgcacactctacaacaccggaattttttgcaacaacgcagacaccggagtcaactgctgcttttgcttccataccggtacctactacaggagcttctgttgtaagaagcggaacggcctgacgctgcatgttggaacccatcagcgcacggttcgcatcatcgttctgtaagaacggaatcagcgctgtagcaacggagaataccatcttaggagatacgtccatgtaatcaaacatatggcgttcatattcctgagtttcttctctgtaacgaccggatacgtttttatgaatgaaatgaccctctgcatccaacggctcattcgcctgtgctacatggtaattatcttcttcgtcagctgtcatataaacaacttcatctgtaacacgaggatttttcggatcagatttatcgattttacgatatggagcctcaacgaatccataattattaattcttgcataagatgcaagggagttaatcagaccgatgttcggaccttcaggggtttcaatcgggcacattcttccataatgagaatagtgaacgtctcgaacctcgaaacctgcacggtcacgggacagaccaccaggaccaagtgcggataaacgtctcttatgagttaactcaccaagagggttgttctgatccatgaactgtgacagctgggaagaaccgaaaaattctttcactgctgcagttaccggtttgatattgattaaggactgcggagaaattgtatcgctgtcctgtgttgtcattctttcacgaacgactctttccagtctggaaagaccgattctgtactggttctgaagtaattcaccaactgcacggatacgtctgtttcctaagtggtcaatatcatcatcatttcccagaccatattccagatgcatattgtagttgatagaagcaaaaatgtcttcttttgtaatatgcttcggaattaattcatgaatatcacggcggattgcttctttgatatcttcaatgtcttcattttcttccagaatcttagccagtaccggatagtaaaccatctcggaaacaccaacttcttccgggtcaatatcaacaaagcttgtgaggtctaccatcatactggacagtactttgattttacgctcttcgccctgaatccatacgaaaggaacagctgcattctgaatctggtcagccagtgcttttgttacaactgtacctgtttctgcaataatttcacctgttgtgacatctacaacttcttcagccagcggatgccctacaatacggtttcttaataacagttttttgttaaatttataacgacctacttttgccaggtcataacgtcttgcgtcaaagaacatgccattaatcagactctctgcgctgtctactgcaagcggttcacctggacgaattttcttatacagttctaaaagacctgtatgataatcctcagatgtatctttaccaaaacttgcaagaatctttggttcttcaccgaataaatctataatttctgcatttgtacctacacctaaagcacgaatgagaactgtaatcgggacttttcttgttctgtctacacgaacatagaacacgtcattggaatccgtctcatattccagccatgcacccctgttcggaataactgtagcagaatacaaggtcttacccagtttatcatgagcgattgcgtagtagatgcctggagaacgaaccaactggctgacaattactcgttcagcaccgttaattacaaacgttcctgtagcagtcatcagtggtaaatcacccataaaaatctcgtgttcactgacttcgtcattttctttgttgtataatcttacctttacttttaaaggtgcagcataagtcgcatctctttctttacactcttcgatggagtattttacttcatcttcgcataaagtaaagtcaacaaattccaagcttaacttaccgctataatctgcgattggagagatatcttcaaaaacttcattaagaccttcgtccaaaaaccactgataagagtctttctgaacttcaatcagattcggcatttccagtacctctttctggcgctggtaagtcattctcatgctcttaccggatttaatgggacggattctgtttttctccattgacgtttcaccccttgtatgttttaattttattatggattatgattcagatcctgttttcttcctgtaaatttataaataaatagaataacaggcataagtttccataatagtgcatttttcactttatcacattctataatgcatgtcaagcattttttcaactaaattttttcattaaaatttttcattcttggataaacaaaaccccgacatccaaagatgtcggggtcaaaagttctggcaagtttacacttaaattatttaagagtaactttagcgccttcgccttcaagttttgttttgatttcttcagcttctgctttagatgcgccttctttaacaactttaggagctccgtcaacaacttctttcgcttcttttaagcctaatccagttacttcacgaactactttgataactttaactttgttaggaccaacttctgtcagttctacgtcaaattcatctttttcttctgctgcgcctgctgcatctcctgctgctgcaactacaacacctgctgctgcggatacaccgaattcttcttcacaagcttttactaattcgtttaattctaatacagataattctttgatagcttcaataaattctgctgttgttaattttgccattttaaatttacctccattttttcgtttttcaattttagagtaccggataaccggtcatatttcttattttctaccgcacattattctgctgctgcgccaccctgctgttcagcaatctggttaagcacacgagcgaagtttgtaatcggagactggatacttccaagcaattttccaagaagttcttctcttgatggtacttttgcaagagcttcgattccagctttatcatagtaagtgtcttcaacaacacctgctactaattccagagtcggaacgtcttttgcatatttagcaagaattcttgccggtgcagttgcgtcttctgcgcatactgctaatgcatttgttccttctaagtgctggcataattcttcacaaggagttcctttgaatgcaaagttcatcattgtgtttttgtatactttataagtaacaccagcttctcttaattccttacgcatctttgtatcctgttcaacagtgatacctttgtagctaactaatactacgcttgctgcaccattgatgctgttagcgatttcttctacgacaggctttttaagttctacttttgccatgaattagtgcacctccttatttttttaggctgcgctgctcctttacgaaaggtacttcaatattagtacttacaaaaagacctctccgcacaagacagagaggttttatcaatcctaaactttgtaagaatgaatctttcctcggcaggcgttttaaccttatgcctaacggcacctgctgtcttcggcagctattcctctagcagaataccaaacctatagaggtttgtcaagaactttttttatttttttattttacaacacaaaaaagacgccatatctctcttgcttagatacgacgtctttttctaaaatctattactgagctaattttaccgggttaaccttaacacttggtcccattgtagaagcaagtgttacactcttcaggtactgacctttcagtgtgcttggtttagcctttgcaatagctcccataagagtctggaagttgtctgctaactgctcctctgtgaaagaagcttttccgattggcacgtgaatgatgtttgttttatcaagacgatattcaatcttaccagctttgatttcctgaacagcttttgttacgtccattgttactgtaccagcttttgggtttggcattaagccttttggtccaagtacacgacccagacgaccaacaacacccatcatatccggtgtagctactactacgtcgaaatctaaccatccttcgttctggatcttcggaattaattcttcagctcctacgaagtctgctcctgctgcctgtgcttcatcagcttttgcatttttagcaaatactaatacacgaacagttttacctgttccgtgaggaagtacaactgcaccacgaatctgctggtcagcatgacgtccgtcacatcctgttctgatatgcgcttcgattgtttcgtcaaatttagctaccgctgttttcttaactaaagagatagcttcttctgtttcatataaatttgcgcgatccactgcttttgcagcttctacatatttctttccgcgtttcatattaataacctcctagtggtaattgcgggaatgtccctcccacgttcgtttgatagttaattactcttctacagtgattcccatacttcttgcagtaccagcgatcatgctcatagctgcttcaagagaacctgcatttaagtctggcattttcatttctgcaatttcctggatttttgctttggaaattgtagcaacttttgttttgttaggaacgcctgaaccagatttgatgttacaagctttctttaacagaactgctgccggcggagtctttgtgatgaagctgaagcttctgtccgcatatacagtaataacaacagggatgattaagtcacctttatctgctgttcttgcattaaattcctttgtaaactgtacaatgtttacaccgtgctgacccagagcaggaccaaccggtggtgctggtgttgcctttccagctggaatctgtaatttaatatatcctgttactttctttgccattttggcacctcctaataatgtggtaatgtcggggatttccctcccacgggcctgtgacctacggcccttttacttttgttacaatttctttacttccgcgaatccgatttccaacggtgtttcgcgtcccatcatctcaacatttattgttaccgtacgttttgcttcgttgatgctctggattacactctctgtgtctttccatgcaccacttgtgataacaacgctgtcacccacttcaaaatcaatctgaactactacgttctgaattccaagacgttccatctcagcttctgagagagcaaccggcttggaacccggacctacgaaccctgtaacacctctggtgtttcttacaacataccatgtgtcatcattcattaccatgtgaattaaaacgtatccagggaacatttttttctgaacaattctacgtttgccatctttgttctcttctacgtcctctaagggtacgcgaacttctaaaatttgattttccaggtgtcggttctcaattgtcttatcaatgttggcttttaccttgttttcataccctgaataggtatgtacaacataccaatttgcttctgacatgctttcaccttatccttacttaatcaataaattcaatgcctgcagagctgcactgtcaactgctgaaataagtacacctataatcgcagtaataactacaacagcaacggtctgttttaccagtgtctgctgttccggccagactatctttttaaattcagcctgaagtcctttggtccagcttttctttggagcttttccttttttctctgcttccatagcttcacctcacagccagattattttgtttctttgtgcaaagtatgagccttacagaacttacagtactttttagtttccatacgttccggatggttctttttctcttttgtcatgttgtaattacgctgtttacattctgtgcatgccaatgtgatttttacgcgcacgacttccacctccatgtgtcttttatcgccggcagattcacgtttctgcctttgcaacgtttccttgtttaccgcgacaaatctttttttatcctttgttttaggcacaaaaaaaagacccacttccactgtcgcttttccagtctaacatagatgcaggtctttgtcaattactttattttcttttaacactcatatcgtttatcgttttttatattccgtaattgtttcacggattttgttgtaatccttacatacttcctctacctgttctgcatctggcataacctttctggaacgcaaagcctctgtcaatacagaacttgattctgcaagattatcaaatcccatgttctgtgcaacaccttttaaagtatgcgccgcacgaaacgcagcttccagatcttcctcctccagcgcttttttcagattttcaaaacttggatcttcttcaaatttaaataaaaatttttctactaatttttcattatacagacgccttacggtatcttcataattaccgcctaatgcatcataacactcttttaatgtcatttttttccattctccttaaagtcaaattattttattattctattttttaatactttttgccccatacttttgttcgttactagtaacataaaatactttatcttatttgtcaagtttcttttctctgaaaaaaagaaaaggaaaaacgaaattttcttttctcgtttcccttttctcattcgtgctgattagtcgtcgattccgacgataacagaagttgctttgctgactactcccacaggcaagcctatgaagtttcgccactaaattataacttttatcaatcagatttttcactcaagaagcatgagagactttttcggaaacaccatataagatggtaatggttgttccgttgtctcttttaaatccggtttttcttcgatataccaaagtctcttgctctttggattttcagcatttttaaacaaatgctgattctcaaacggagtctctgtataaccggccgatacaattttcatggaatttattttttccggcacgtctgacggtttcatatagtgtgcccgaatcccaatatattttatggaatcttttacttcttcttccgtttcaaatacaaaatcccagtccctggcatacacactgtgactgcctcttttttctgccgcagaaatatttttacagccggtcaatctcgctgcttccatctttctcggatttgcaaaaatatcggttgtctttccttttaagatacagctgcctttttcaagcagtaccatattgtcacaaaaacgatagatttcatcccttgaatgagaaaccatcagtacatccttttggtattcttcaatcaattccagcatttcaagctgaagcgtatcttttaaaaatccatcgagcgcagaaaatggttcatccaacataattatttccggctgatggagcaacattcttgcaagtgcaaccctctgctgttgtccgccggacagctgggaaggatatcttttttccaaacccgaaagttcaaaacgttcaagctgctcttttatcttcgcccgtttttcttcttttttgccctccattacaaccatcagattctgttctacggtcatagtcggaaataaggcataattttgaaataaatatccgacatttcttttctgaaccggaagattaattttcttctcggaatcaaacaatactcttccatttaatacaattcttccgctgtccggtttttcaattccggcaatacattttaaggtcatgctctttccacagcccgacgcgccgaggattcccatgcatccctcttttgtttcaaattccacatccaatgtaaatccggaaaattttttctttatctttgcctgtagtgccatatcacatccacctgttcacatttttcatattttttcctgatatcagattgatgagtgccacaatcaggaacgataaaattacaatcacacagacccaaaatgcagcggtatcccagtttcctgcggcgacctccgaagcaattgccacggataccgttctggtttttccaagaatatttccagcaagcatggaagttgccccatattctccaattgctcttgcaaatgcaagtaccgtaccggatgcaagtcccggagctgccatcggaacaactaccttccagaaaatttttctctcagacattccaagcgttctccccgcataaatcacatttacgtcaatctgttcaaatgctgctcttgcatttcgatacataagtggaaatgcaatgacaagtgccgcaatcacacagcccggccaggtctgaaccagcttaatgtcaaactgtgtgtataaatactttccaaatggtctccgcagactgaaaatcagtaacagaaagaaacctgctaccgtaggcggaagtaccagtggaagtgtcaataatccatctacaactgcttttgcggtattgtttaatttcataataaaccttgcggctgcaattcctgcaaaaaacgcaagcacagtcgcaagaatacctgttttcagagaaataaaaagaggactccaatctattgtctccaaaatttcagccatagatcttcacccccttttgttcttatttactttttattcttctgtatactgtttaaatcctgcttctgttaataattccatcgaagatggatctgttgcaacatattttttaaattcttctgctgcttttacttctgcatcacttgcttctttatcttcaattaatccaatcggatagatagccgggtcaacctggtctgcagttgcttccgcaattacttcaactttatctgccatagaagctgcatctgttgcatatacaacaccaacttcgttgcttccttctgctaccgctgtaagcactgctgtaacatttgcaccttcgttgatttccatcgccattacatcatcaagatttccgatgttttcaaacaattttcttgcatactgtccaaccggaacatcttcacctgcaagtgcaaggctggaagcctctgtaatattatcaaatcctgtaactgctgtttcttctccggttggtttaattaatacgattttattttccagtaaatttgtcacagaaccatcgattacataaccttcttcagttaaagcatccatctgctttgtagctgccgagaagaaaatgtcgcactgtgcgccttcttcaatctgagtctgaagagttcctgaactatctgcattgtagataatgtttacattcggatgctccgcctcataatttgctttaatttcttccattgtgttctttaagctggctgcgataaacacataaacatctgtcttttcgccggaagcctctgtctcatctgctgcatcagcttcttctttgtctgtctcatccgctgctgcatcttcttttgtgtcttttgcactgctgtcaccagaatcactgcttcctgagccacagcctgcaagcatggttgcaccaagtgtcatagacagtaaaagtgccatcatttttctcttcatatttgttttcttccttcataataactataatttttatggttatattttagaaaacaattcggtcaatgtcaactaataccggcaataaattacaggttttctccatttttctaattacttcactataccagtatgcagaacctttttaaacatactgaaattcattatagtaactatatagtaactattttcttcgtgccctcagttcccttggtttacatccatacgtttcctgaaacatcttattaaataatttataattggtaaatccatgtttttcggttatatcaaggatattttctttggtactgcataaatcatgataaatgtgcatcaaccggatttgatttaaatattttgaaaatgtaacacccatattttctttaaaaaaacggctgaaatactcacggctcagataaaatcgtccggacacttcttctaatgacagtcgttctgtatgatgttcttcaatataatcggtaatctcagaaagcctctccagtcttgtgtcatcttcccgtaacgtaatcgcagtctttggataggaaaaagcgaataacagctttgacataatctgaagcgcaatcgcctgccgttccagccgatagccaagtggctgattgacataaagaggcggcaatttttttaacaggtcgcaaatctgaaaataatcttccagatttgttcttaataattcacttcttcggcagctgattctatacttttccagatttggttctatctgaatcatcgcacttcttgaaaaatgaatcactatcatcatggaagccctggcgcaccttgcttcatgaatctgattggaatccaccacaataaattctccggcaatcatcttatattcttttccttcgattaaaatggtaccgactccatttaaaatatacatcagttcaattgctccatgccagtgagccggtgtgtattctccctgattggtatgatacttgatattaataccatttttttccaattcaaacaaaggttcataaatcatattaacttctccaaattttgcacgccattgcgtgctttctttatttctgtcgacttccttccatttttgtatacaatgtcaatattaaccgaattaatagctaaaaactcatctaaacacttcatatctttcatgctattataacactcgtaaagaacaaagaacagtataaaaaaggagatgttaattatggcaagtactacagctacagctatggtaaaagcaaataaagaagttaaaaaagttacattatgggaacgttttaaaaactatttaattgaaaacgttgatatcattgcaccaggtattatcatgatgaatggcggaacctattttccaaaactgaaataataggctccgccttttttttatcctttaatctgccgttatttctgcctcctgcgtaccatttacattcaaagttttccaaatttagagcagcaaaaaagccctctgacaaaacttaaagttttgccagagggctttctaaaataaattttaattcgttttacaattagtcctcaattgtaactttgtccagatgccagatttcatccacgtactgctgaatggttctgtcagaggagaatttaccggagcatgctgtatttaagagtgctttcttagcccaacctgcttcatctctgtaagcttcttctactcttctttgtgcgtctgcataagatttgaagtcagctaaaataaagtaagtatctgcacggtcactgcagtttgtatttaataaggaatcatagatttcacggaacatttcaaagtcgccgtttgaataagtaccgttaatcaactgcattaatacatttctgatgtccgggtcattattaaagtactgcattgggtcatatccgccattattttcgtagttgataacttcatcagaagacagaccgaagataaatgcattttcttcgcctacttcttctacgatttcaacatttgcaccatccattgtaccaacggtaagtgcaccgtttaacatgaacttcatgttaccggttccggatgcttctttacttgctgtagaaatctgttcggaaacatcagctgcagcaaagatgatttcagcgttggatacacgatagttttcaataaatacaacttttaattttccgttgatggaagcgtcgttgttgatcacgtctgcaactgagttaatcagtttgattgtcagttttgcacgtctgtaaccagcggctgctttggcaccgaagataaaggttctcggataaaaatctctttccggatgttctttaatctgattgtacagatacataacatgcagaatgttcattaactgacgtttgtattcgtgaagtcgttttacctgaacatcaaagatggagttcgggtctacttcgattccgttatgctctaagatatattttgcaagacgcactttattctggtatttaatgttcataaattcctgctgtgctttcttgtcatcggcataaacttttaacttagcaagctgtggcaggtctgtaatccatttgtctccgatgtggtctgtaatccaatctgtcagaagcgggtttgcatgaaccatgaaacgtctctgagtaataccgtttgtcttattgttgaatttttccggatacatttcgtagaaatcttttaattcctgttttttcaggatttcggtatgcagtcttgcaacaccgtttacagaataaccacctgcaattgcaagatgtgccatcttaacctgtccatcataaataatagccattttgcggactttttcctgatttccaggatatttctggttgatttcttcgatgaatctgcggttgatttcttcgataatctggtaaactctaggaagcaatttggagaacagctcgattggccatttttccagtgcttctgccatgatggtatggtttgtgtaagcacaggtatgtgttgtgatatcccatgcatcatcccattcaagtttttcttcatccagaagaatacgcattaattcagcaactgtcattgtcggatgggtatcatttaactggaaggttactttcttcggcaggtcatgaatgtcgctgtgttttttcttgaattttgcgattgctgcctgaatacttgcagaaataaagaagtactgctgttttaaacgaagttctttacctgcatagtgattatcattcggatagagtacgtcacaaatattttttgcaaggttttctgcttctaccgcttttctgtaatcacctttatcaaataagtctaactggaattcattcattgcttctgcatcccagatacgaagagtgtttacaattttgttgttgtaaccaacgattggcatatcgtaaggtacggcacgtactgactgataaccttcctgaatgaagttgtttctgcctgtagccgggtcgtattctacacgaacatatccgccgaattttacttcttttgcatattccggacgacgaagttcaaatggatagccatctttcagccagttatccggaacttctacctgatatccgttttcgattttctgtttgaacagaccatagtggtaacggataccacatccataagcacagtatccaagtgttgcaagggagtctaagaagcaggctgcaagtcgtccaagaccaccattaccaagtgccggatccggctcctggtcttcaattgtatttaaatccagtcctaactcatcaagtgcttcttttacttctttgtatgcacacaggttgattaagttattaccaagtgcacgtcccattaagaactccatggaaagatagtacacaatcttcggatcatctttttcatactgtttctgtgtcaaaagccagttatcaataactacgtcttttaccgccagagaaactgcctggaaaatctgctcctgacttgcctcatccaaggtctttctataaagcatctttacattctcttttacacttttcttgaattcttcttttctgaaatgtgaatctaacatacttttcctcctctgattttttctgtgttttttcatctttttcttctcaaacatcccaaaacacaaaattatattaattatgggagtccccttcttcaagagactcccatagtaatatactgcatgcggcagaattattcggaaattttttctactcctaatgttactttttcagagttgattttccactctttgacatatccggctgtttctgtgtaaacaacatcttctgctaatacctcggatttgatatctgcttcgtgagcacggaaaatcccctcaattacatcattaccgcttaaggaaattttaatcttatccataacttcaaatccggcttctttacgcattgtctgtactttactaatgatttctcttacatatccctcttcaattaactccggagtcagatttgtgtcaagtactactgtgatgtcattgtctgattctgaaacgtacccctccatctgagcagtatcaataagtaaatcactctctaataatacaatctcttcaccagcaatgtcaagtttcagctcaccggttgccttaagttcatccattgctttatttccatctaattcagccagtgctgttttgattgcatttaagtgttttccatatttcggacctactgttctaagctgtggcttaaagctgtaggaagtaaattctcttacgtcatcggtaaatgccatctcttttacatttaactcatctttgatgatatcagtgtagaaatcagacagagtaaaggatgcctttacaaacatttttccaattggctgacggtttttgatatttgctgtatttctgcaggcacgtcccataaccacaatttccagaaggtcttccatgttttcttcgagttctttgtcaatccatgcttcatttacagcagggaaatcacaaagatggatactttccggagctgttttatcaatgcttcttaccagattctgataaatatcttctgtcataaacggaatcatcggtgcagctgcctttgcaactgttaccagtgcggtgtacagagtcatataggcattgattttatcctgttccattccttttgcccagaaacgttcacggcttctgcggacataccagttactcatatcatctacaaattcctgaagtgcacgtgctgtttccggaattttgtaatttgccagattgttgtctaccgtctgaactaaagtatttaacttagacagtaaccatttgtccatgacagcgagtttgtcatactctaatgtatattttgttgcgtcaaattcatcaatgtttgcatacagtacaaagaatgcataggtattccataaagtacccatgaatttacgctgtccttcctgtacggcttttccgtggaaacggtttggcagccatggagcactgtttacatagaaataccagcggattgcatctgcaccgtaagtttcgagtgcgtcaaacggatcaactgcatttcctttggatttactcatcttctgaccattttcatcctgtacgtgaccaagaacgataacattctgatatggtgctttattaaataataacgtagattctgcaagcagagagtagaaccatcctcttgtctggtcaactgcctcagaaataaactgtgccgggaactgcttttcaaatacttctttattttcaaatggatagtgatgctgtgcaaatggcattgctcctgaatcaaaccagcagtcaattacttccggtacacgatgcatggtctttccgcatttcgggcaaggcattgtgatttcatcaatatatggacgatgaagttctactgttttggctttttcgtcaccactgagtttgcagagttcttcacggcttccgacagactgcatacatccacattcacattcccagatatttaatggagttccccaataacggtttcttgaaataccccagtcctgtacgttttccagccagtcaccgaaacgaccttttccgatgctttccggaatccagttgatggtattgttattgcggattaagtcctcttttactgctgtcatcttgataaaccaggattctcttgcatagtagataagaggagtatcgcatctccagcagtgcggataatcatgctcgaatttcggagcatcgaataataaaccttttgcatccaggtcttttaatacttcagggtctgcactcttgacattcgggtctttttccatttctgctttagaaggttttgctctcattcctgcaaatggagtttctgctgtcatgcatcccttttcatctacgaatttaaccagcggaaggtcatattcacgacccacacgggcatcgtcttcaccaaatgccggtgcgatatgaacgataccggtaccatcggacatggttacataatcatcacagattacataatgtgctttcttatgctgtttttctgcttcttttgctgcacattcatacaatgcaacataagattttccttccagatctgttcctttataagtttccagtacttcgtaggccggtttgtcttcttccgctaattttccaagaactttatcaagcagagcttctgccatataataaacataaccgtcaactgattttactttacagtaagtatccgatggatttacacaaagtgcaacgtttgaaggcagagtccatggggttgtggtccatgcaaggaagtaagcatcttcacctactactttaaaacgaaccactgcggaacgttcttttactgttttataaccctgtgcaacttcctgagaagaaagtggtgttccacaacgagggcagtaaggtacaatcttaaatcctttgtaaagcaggtttttattccagatttcttttaatgcccaccactcggattcgatgtaattgtcgtcataagtaacatatggattttccatatcagcccagaaacctacggtagaggagaaatcttcccacattcctttgtatttccatacactttccttacactgctggataaacggctccataccataagcttcaatctgctcttttccatccagacccagtttcttttctacttccagttctacaggaagtccgtgggtatcccatccagcctttcttggaaccatatagcccttcattgtacgatatctcggaatcatatccttgataacacgtgttaacacgtgaccgatatgtggttttccgtttgcagtcggaggaccatcatagaacgtataggtttctccctgctttctctgctccatactttttttgaagatattattatctgcccagaatttttccgtatttttttctctttctacgaaattcatattcgtatcgactttctgatacatcgtgttactcctttctttttttaaaaagaatctctcttgcgagattctccgcctgcggcgggtcgcttttgcgacatgtttccataccgacgcagtgcgaacctcgcggagtgtttttatcatatagaaacgaggttttctatatgataaaaaaaactctcgccctgcaacaggacgagagtaaatcactatcgtttcataccacctcttacacataccaacatacgcgttccttttaacggaggaaaaccggcatcccttactttttatctcaatcgaaaatttcaggcagcaactccggagtgattttcttttgttcttactcgcatcgggcttccaccgtccccgactcgctgttgctttcaacaacaaactactgtctccatcaccgtttttatcttgctttattataaatagggaaagagggaaatgtcaagggggaattcacagtattaaccgtttcatgcaagatggcaaaatcagaacttgttgcagatatagtataaatcccattcgattctataatctgcttcaccaattctctatatcgccaaggctttcccttgtaaaataaattacttcatgataggctatatatacacatgaatatacacgtaaattcacttatcattttatatagataccggtgcagaaaataaaacaggaaaggaaagatagaacatgcagaaaataccacttccaacaggaattgatgattttaaaaagcttcgcagtaataataattattatatagataaaactattttaattgaacaggtcgtagaaacccgaagtgaagttactttattcacacgtccacgtcgttttggaaaatcattaaatatgagtatgcttcaaaatttctttgaaatcggaacagacccttccttatttaataacctgtatatttcaaaaaatacaaacctgtgtgaaaaatatcttggaaaatatcctgtcatttttatcagtttaaaaggaattgatgcagattcctacgaaaaagcccgtgcacagctgataagaacgttaaaccgtgaagcaagaaaattccaatttcttttagaaagtgacaagttaacaaccattgataaaaaattgtttttggaacttttagaccgaaacatggaagaagatgcgattaccagcagccttcaggaattaacggaattattggaaattcattatagccagaaagttatagtactgattgatgaatatgatgtgcccttagcaaaggcgcatgaaaatggttactatgacaaaatggttcttctgattcggaatctatttggaaatgctctaaagacaaacaccagtcttgcatttgctgtcttaactggatgccttagaattgcaaaagaaagtatttttaccggtctcaataactttaaagtctattccattaccaatgttcagtttgatgagacttttggctttactgacgcagaagtaaaagaaatgcttcattactatgaactcgacgataaatacgaagaagtacgagaatggtacgatggatatcactttggaaaagcagatatctactgtccatgggatgtggtaaattactgcaatgaccatttgaataatccagatgcagaaccggaaaattactggatgaatacgagcggaaacagtattatcaatcactttatcgacagcataaatgaaccggatatgcttacgaaaacagaattagaaagacttgtaaatggaaaactggtgcgtaaacgagtcgataaaatgattacttataatgaattgtattccacaatggataatctttggagcaccctttttatgaccggatatctcacacagcaggggaaagaaagtgacggacgctactgtctggcaatcccaaacagagaaatccgaaatattattactgaacggattcttacactgtttcggaatgaggtgaaaaacgatggcaaaatggcggaaaaattctgtcaggcattgataaatcaacagccggaaaaagtcgaagaactgttaaacgcttatttacaaaaaacaatcagtatccgagatactttcgtacaaaaagcatttaaagaaaacttctatcatggtatcttacttggaattttaagctataaaaacaattgggatgtctcatccaatcgagaatctggaaatggattcagtgacattttgattgaaaccgatgatccagaagtcggaattgtaatagaagtcaaatataccgatgacaatggctcaccggaaagtgactgcaaaaatgccttaaaacagattgaaacgaaaaattacgcacaggcgctggaacaggatggaattcggaaaattttgaaatatggaattgcgtttcagatgaagaaatgctgcgttaaaactcaaggttgaatcatatctgaaaaccagtcaaaccattaggtacggggaatttaacatattctccgtacctgatgcattatactaaagcacaatatgaattccatttggttctataatctgctaactgatttgcaatacgctcctgcttttttgatggttctcctgcataaaaagcgattttattgaaagtaaaatgattgatttcaggaattgagatagaatcttttaagaaaaactctacatcttttcccaatgcctgtgctattttttccatatctgtaccactttcatcctgcactccggttaacaagcgagataatttattcttatcaatccctgtcagcatactaagacagttctgcttaattttcatctccgacagatatttgtttaaattatttataaattttgtcatgttattctatcctctttagtgttgtgacggtttacactttataatatatcatacacctttcttcttatttatcgatatttttcttatttatcgatatttttcctattttttgagattttaaattgtttttttgctttaatttgatttttattttttattaatctattatattttcttattttttgagtgtttcaacgaatggaaataaaatagaagcttccaattctacttctatgtaaattgaagctattaaatttaatagcgacttataaatttgatagtaactttaaaaataatcacctccaggctataatgaagcaaaatgatagcttaaaggtgattttatatggcgagatataagaaaaaattagagaacgtcctcccccaaccgctaagccggttgagggagaacaagcgaatattccgtatcgtggttacgatttttcgaatccgtacatccattttcctcgtaagaacagatacagaaagatcacggaactgatactccaggttaatgggtatgcccagaaaatcactcgtatatctgggagaatacgaactgccacagtaatgtagcttacgcgaaacagacaccagtcacataacataacgatcattggaacggaggcattgcctgagccacgaagtactgctgcgatacaatgagaaaatgccagcaaacaataaaataatgcaataattctagcctgcatgactccataatgcacaacatcaggatctctgttaaaggctgtgatcagtatcggtgctgccgcatatatgataatacctatcaattctgcaatcgcaatcgaacaaagtacaccaaattttgctccctttttcgcccggtcatactgttttgcacccagattttgactgacaaaggttgtcagagccatcgtaaaacaggttaccggcaaaaaggcgaatccctctatcttagaatatgagccacatcctgccattgccatttttccaaatgcatttatatttgactgtacaaaaacatttgcgatcgcaatcactgaattctgaaaaccggatggtacaccattctggatgatctgctttagcataaaactgtcaaagcgaatctctcgcaattccagacggtattcctcttccactcgcagcagatgaaccatacagagcagtgcactgacaaactgtgaaattgcagtcgcaagtgctgctgatccgacacccataccaagacctgcgataaagaaaatatccagaacgacattgacacaggaagaaataatcagatatatcagtggatgacgtccatcaccgactgactgcagaactccaacaaagatattgtacatgacaacacctatagagcctgcaaaatatgtacggaaatacacaatagattctgggagcacatctgcaggagttcccatcaataccaggatctttggtgccagaaacatccccagaacggtcagcaaagcaccggacacaagcccgaatgcaaccgttgtgtggattgccttttgcagaaagtcactttttttagctccataatatcgtgcaataacaacacctgcacccatggcaatgccgttaataaaacctaccattagaaaaatcagatttccggatgaactgaccgccgccaacgcattacttccaagaaaatttcctacaatcagggaatcagcagtattgtacaattgctgaaacagatttcccagaaacaatggaattgcaaaaaaaatgatcttttgggagatacttccctctgtcattctcagactctttttcatagccaaaattaccctttcccttcctgcgttctttgcgtgaatagagataaaggactgctctttatggcagttatctctctataattagtgaactactcagctacaaataaccgagcttcttgcttaaaaattaattggctttctgtcggttaataaatgatagaaaaaaccagtctaatcatatcacttaccctttatgttttcaaataaaatccttaatttttctcatctaatctcattttttttcattttcttaatgaatccttagttgagatatcgccataaatggactatactattaaaatgtgagtgtcaaagttaattttgccacttaccaatgtacatttttttataaggggtttttattttatgaatcatttaaaacatcgggtaatctctgctgtctgttcgattacccttttatccggcactttttcacttccggtttttgccgccgacgcaaactcttccgaaaacacggaagcaatttctcagacttctgaaactgctgcaccgactgatactacaactgcccaatcttctgatccagcttctacagatactacatctggcacaccgccgactgacccaaatgctccgcctgaaagttacaactgggaagttcaatccgattcctgggcttcctggccaaaaggtccgcaagtcgctgccgaaactgccattttaatggacgtcgattcaggcgaaattttatatgcaaagggaattgatgaaaagcgctatcctgcaagtaccacaaagattatgactgcatggcttgcgattgaaaacagcaatttatccgaccaaatcacgttttccacagatgccgtctacagtattgaacccggaagcacccacattggaatcaaaccgggtgaaattcttacaatggagcaaagcctttatgcggttctgcttgcttccgcaaatgaagtctccaatggcgtagccgaatatgtcggcggtggaagtatctctgcttttgtcgataaaatgaatgaacgtgctgcgtcccttggctgtaacaacacacattttatgaatccaagcggtctgcacgatgacaatcattatacaaccgcacgtgacctggctacaattgcccgttccgctttccaaaacaaaattttccgaaaaatcattggaacagaatattatatagaaccaaaaacaaatatcactgatgaagaacgctggcttaataatcataacaaaatgctgctctccggtgaaaaacattatgatggctgtcttggcggaaaaaccggctacactacaaccgccggaaatactttagtcacctttgccgaacgtgacaacatgcgtctggtctgtgttgtccttgccgacaccctgcgttttcagtacagtgatacggcttcgctgtttgattatggatttgggaattttcataaagaagtgataacagaaaatcagccggaaactactgttcaattactgcctgcggatgcgttttcgctgaaaatgacaactcccgaatttctctcctgcgtggaaaacggcaactgcgtaaccctgccaaatgatgtgtctttagattcggttacttatgaaacacgcgtggaaggcgattccgtatttactgactgtctctttaacaatcagatattaatgacgaaacaggtaaagattttaccatcaaaatcaattcaaaaatcatttaaagcgatgaatcaaaaaaagacatcaaaatcaaaaaaggcgaaaaaaagacatcactgatgtcttttttcacgccttttttcccgaagcagatttcgtttttcccgaatctcaactgcttcttcttcattaattttctttactgtttttactacataataattgccttcatcggttttcttcaaccggattttcccttttaaataaccgtgttccggacaatatgccaggcagacatgggatttggtattcatagaaaaccagcgtattttcttctttgctgtattattacaaacaatgcattttgtacttacgacttccctgtctttcattgcgtcttcttttgttggaaattctcttgaaatatattttgaataattctcaaacatgacatgaatttcttcttttttggatttcggattctgataagtatcaatcgagtaatttttctcaaccacctcaatcggcaattttgcaaacacctctgccgtataccaggcatcatgaagtgcacggtgaaaactctctgtcttttctattttaagaaaatcaattgcatattccagggaacggcagttttttttaccctcacaggcaatcccaaagattttctgaaggtcataataacgaaccggtccttctaagaaatgcagcatggtatagtatttcaaatttcgctgaagttcaatcaaatcagttggtccccaggtacaaaatacaacgtcctctccacaccatctcaaaaaacgccttactgattttgaaaaagaaagcccgctctctaaggtatttttatcaatgtttaaaatttcttttgttcgataatgaagtctgtgatagacagccggttttacaatctgctggaatttatcaattacttctcgattttcatctaattttaccgctccaaattcaataatttcaaacggcaatcttttattttcacggtcttttccataaggacactggttccactctaagtcaaatacaatataattcatttctttcttctcactaactaactatttactctgctgctgtaatattaccatgatgacctcttattcgcaactgaaaatcatagtacagaaaaaaaagcaatacatacttttacaaatatgtattgcttcttctctttgttttttattcttccgctccaatctgcggcattggctctgccagaattttcataaattcttcacctgtaattgtttcattatcgtaaagatattttgcaagctgatgcagttttccgatattatcctcgagaatcttataagcttttgcatgctgggtttttaccagttccacaacttttttatcaatctcagtctgagtttcaaatgagcatgcaagggaagtatctccacctaagtactggttctgaacactttccattgccaccatatcaaaatcatcactcataccgtaacgggtaatcatacctcgggcaagctttgtcgcctgctcgatatcattggacgcacctgttgtaatggaatggaaaatcaattcttccgcagctcgtcccccggtaaaggttgcaatcttattttcgagttcttcttttgacatcagataatgctcgccatcttccacctgcattgtataaccaagtgcaccggaggttctcggaataattgtaatcttatgaaccggtgcagaatttgtctgcatcgctgctacaagcgcatgtccgatttcatgataggaaacaatcaatttttctttttctgaaagtacacggctcttcttctgataaccggcaataacaacctcgatactttcttccatatcagcctgtgttgcaaattttcttctgtcacgcaccgcacgaagcgctgcctcatttacgatgttggcaagttctgcaccggacgcaccggacgctgcttttgcaatttctctaaagtccacattatctgaaactttaatctttttcgcatgtacttttaaaatttcttcacgtccctgcagatccggaagttcaaccggaattcgtctgtcaaaacgacccggacgaagcagtgcaggatcaagtgaatccgggcggttggttgctgccagaataacaacaccttttgaaccgtcgaaaccatccatttctgtcaaaagctggttcaaggtctgctcacgctcatcatttccaccgatatttccatctcgttttttaccgatggtatcaatctcatcgataaatacaatacatggggctttttcatttgcctgtttaaataaatctcttacctttgctgcacccataccaacgaacatttcaacaaactctgaacccgagatagagaagaaaggtacatttgcttcaccggctactgcctttgcaagcagggttttaccggttccgggaggacctacaagaagagcaccttttggcatagaagctccgatttctctgtatttttccggattatgcaggtaatctacaatctctgtcaaaagttcttttgcctcatcttcacctgcgacatcagaaaatttaattcctgtggaagatttcacgtaaatctttgcattactctttccaaatgacattgctccaccggcgccaccaccgataccactcatcattttcttactgagccagtttccgataaatacaaaaatcagaatcggaacgatataagacaataataagcttacaatcggagaagttttctgcggaatttcttctgagaattttactcctgcatcttttaagcgttctacttcctgtgagtctttgattcgaccggtcttataaacctgcgtctcatttcctttttttacagaatagtagatgacatcatcttccagattgacttcttctaccgttccactgtcgagagtatccaagaactcatcataagtggcttccttgatacttctctctgcaaggcttggtaccaaaagtgtatttaacagcaccaacacaataattacgattgcataataaaatatcaagggtttttttggctttttatcttttatctccatagccatatcccctttcttttttctttgtaaactactcggcaaccaagttaccaaagcatctaaattaagtagttccttaacacttgctatactaactattactattatgcgccaatttttacctatttacaattaagaaaccctgttaattctctaaaaaaaaaatgaaatttccagttacttatcttaattaattatcttctccggttaatcttaagattccctggatttcttccaaatccatatccaaaaatgcagataactcttcggcactgtatttatcatcatcatcatccatgatttctttgattttatgctccagatttcttactttttctactaaaatatcatcgctctgtttctgatctgtctgttcctctaacagcaataaaattgcatttctgatttcaccggataaaaatgcagaaatatcttctgcttcctcaagactttccagtgcgccaatcaagccgatatttccctcagaaaccatatctccaagaaaaacctctccgtcatgcagctcttttgcaattttaagcacttctttcatatataattctgttaatcttgattttgcctgtgcctctcctgcttttgctaattcaaaaagacgttctctttcgccttcctcttccggaagaatcacatttaatgtttcaagataatcctctaaatattccttctcttcctgtgtcagctcggtcgattttttctcttcttctgcctcctctgcttcataagaaaacatagaacttttctttggcatttctggctctgaaactttttctgctttctttttctcttcatccgtatggattccctgaatggtcagataatcatatactttctgaagctgtgtctcatttaagccatctcccgcaaaaaaatcctccactacctcacggctgatttttcttccattgttgactgcaagtctctgtatatcctgtaatttctgctgaaattctttaatttccattctaacctaacacactcctttttctcacccaattccacccagtgcaattccaagaatcaacaccagaatgcaaatcggaacatataaatatttgcaaaccggataaaaccatttcgtaaatgctttttctcttcctttattgacctgttcttccacgtatttctttccgcatacccagaagaacataattcctgccagtcctgctccgagcggacagatataaatcgacagcacatccatccagtccgatacaattccctgaatcaaaagggaaatcacaattccaactatacctgtcaaagtacatgccggtactctgccaagttttaatttttcttgaaccgtcgcaatcggtgcttcgtaaagattaattaaagaggtcattcctgccagtaaaactgcaacaaaaaagagaatcgcaatcacatgccctccgggcatagatttcatcagatttggaagataaataaataataatccaggtcctccctgatttaatttcgcaccggtcgttgccattgccggaataatgacaagtgctgcaagcattgccgcaagcgtatcaaaaaacgccacacgtcccgcagatgccggaatattctcttcatccgaaagataagaaccataaatcaaagttccgtttccagctacagaaagggagaaaaatgcctgacccagtgcaaaaatccatgttttcggatttgcaagtgcagatttatctactccaaaaatatatcgatatccatccgatgctccctgctgaaatgatacatagattccaagtcctataaataatgcaaagaaaatcggcatcataattttgttcgctttttcaattcctgttgctacaccgaacatcaaaattcccatgcagagaattaagactaccacctgccagatattatttccaaatgcagatgccattgaaccaaactgtgcaccaaactcatctacactttccggtgcaagcgttgctccggtaagcgtacccacagtgtattttaaaatccatcccataactacagtatagccgattgccattgccattgaaccaagtaccggtatcatgccaagcagttctccgctctttctgcttccttttctttccgtcgccattccaaatgcatcaatcggtccggaacgtgctgcacgcccaaaacacatctctcctataactccggtcgaaccgattagaattacaaaaataatatagggaattaaaaaagctccgcctccgtacagggaaactctggtggaaaacatccagatattccccataccaacagccgagccgatgcaggccaaaataaatccccacctgctgttaaatgattctcgtttcttcataaaatttactcgttttctccttgtatattttgtatttgaattataacaaaattcaggagaaaagtaaattttgtttgtaacttattcagcttggttcttccattttgttccaagttcttttaattcttccgcagtgtaaagcggacaaatccagtatttttcttccagccagtttttcattaatactttattttctttttgagaatagcctgcaaactgacctttgacatcatcgccgatttcatagcggatttccattttatccagattaattaaccaggcctgattttgattttgaagtaaaatctcatcaggattttgtgttttccagactacaacatattccgacttttctgcatcatcttctttcttctctttaattgtaatctgctcttctattccatctgaatttttatttactttataaagaatcccgtctctgccaaatacaaatacataatctccaattttatgactccagaaaacagaagataccagattcttctcttgaagcttttctatcaccggttttattttttttgacttcgtgtcgtccgagtactttacatttttatccttagtctgataaatcagactatcctcttcctctataatttcacacgattcattcgttaaatcctgataacgatagaccacatttccacttaccgccagttcatcatcattataccaggcagaagcatcgatttcagatgcaaattcatgaatcactgcacctactgatttttctttttcccctttttctattccatttacaaaaagcatatattcttttccattttctaaagtcactaaaatctgacctgcttctgtataatctatatttataatactgctcggaaatgtatattcataaataatatctccggtattcacatcaatcaaataaatttcttttgtcataacagtgaataaaatatccgtatagttttccgtattttctttcttaaatgttcctaccgctaaatcttccatataagtagctgagccatttaccgttacttctgaaagtttttttgctgtattataatcaaaaatccgatactttgtatactctccctgcgttcccatatttgtctctgttatgagataatcacccgtatgcattactgtaggaaccccttctttttcctggtctacgatttcttccaataacggcttttcatcttttaaaattactccatcttttacagaatatgcttttatcttattttcacaatttccaccttccttatattctgtttcattcacataacaaattttatcagagattgattgtatatctaaatcaaaaaggtcatcccattctttggtatatttatattcctttttattttcaatattgttctcatcaaatacaatcagactacagttaccattttgattccacatacccggaatctctttcgcttcttcatactcttcataaattcgggcaatctttccatcaaacatccgataactgtaagtataagtatcactgtcataatgccactttttttcttcttcacttacttcttcaattcgttcataacttccatccgccggattcactttccagacctggtctacgctggtaagataaaaacatggattttcagcctctccttcacttgtagtttttttatagccataaagcatcatttcacttgtcagttcaccatctgactgaccattgccttccgctgaaactttttctaattttattacttttaatggttcttttttaggaataaaaaacttaacactataagtgtcatcgtcatattttatccccaactcctccaccgtatatttcttcaccagttttccgctctttgtctcccacagataaacccctgttgcatcctgtgccaccacattttttccactgtttacaaatgcaactttcgtaatatatgaagttgtctcatatttttgtaccggcaaaaagttttctctctgaaataatcccagtttttctgcggttgctttctctgccgaaaaaaccgacatattatcttcagcatcaggaagtgcatccactgctgtctcaattgcttctgtcacttttccatcttcccacatataatccgactgaacagccatacgattgtagttttcttcctgcaagagccgtttttgttcatttaatcggactgccatgattgaactgtagataccaattccgccaactacaactgttactccgcccatgacggcaagacttctgtgaatttttcgtttctgttcccgctgatataaatcatcataacgacagtcaagcagtggtgcggcaattcgcaaatattctgtttttaatttctttaatgatttcctttcagaatctgcggttatattcgcagccagaggctctacttcaattttctcccgaatttcttctccctctgcatttttacgaatttcttccgaccagcagagttcttccggaaatacatcgcctggatttccttcaattaaaagtgccagtatgtttttggttgaattattatgtaacgatttaaaatatgaaatttcttccctgcaccattttgactgtgcaagcatagaagaacaaattacaattaaatattctgaattttctaatgcctcacggatatcctgactcaaatcagcacttgtcggcagttccgtttcatctcgaaatactctccatttttcctttttttcaagctgtttcggaggatgaaatgtctctaaatgcttctgtaatgtaactgcaacttttcggtcaaatggctgatgccggtagctgataaaagctttatatctccggttattctgctctgtcttattatctgtcttattttctgttttctctcctgtctcaagctctttctccatcttctttctctctttctttcaaccattctaatgccagaagtcttttggtatctttgatatttgccatatcataactgtaaaaatctttatccattccacattcattttttaatgcaagttttaattctttctgaccctcataagcacagatacaaggatgcagctttgccacaaacaattgctgtctttcatttccacatttaacggcaaaaacagcatcatctgcacttgcagggagccagccacgggacaacatccatcttacccagcggtcatgttcccagaccgctatcgtcttatattcactttcttttactcctctacttcgatttgccagataattcagctgttccaccgaagcaaatgccttctcgtcccagatttcccatgcaatcggcataatctgatttccattaatatcccgaaactggaaaatacgatacggcatgctaagagccagactataggaactgtcatgattatattgtcttccataatagaccttatcttgctgttctgccttttcactgcccgctttggtctcttccggactcagccccgcaaactgataatgaatacactttgaaagtttttcaaaagttcctccagccatcaaatcccagctataatatgccgaaagatttccaaacggaataaaggaccaggtattaaaccatctgtctccatatatttccttttcaattaccagtctttttgcagtccatgcaatctggtctttccgacacagaactgcaatcggatttggattctccagtgctgtctcatttctctgttcaatattattacgaaccagaatttcacggattcttgttgccagtgaaagattttcttcatctgattcagtcgctaccgcaaaataaccatacggagtttcattcattatgttctttaagatatccgctaactgaaaagaatgaaaatcaatattttctcctaaaacctccggcagttcaatctcttctacatcaaaatcgctttttaccattcccgggtattctgcctttattttacgaacaaattcttcgcctttctcatctaacaccgtaatcttacataaaatcgcattttcacgaaatcccatcatccagaatgcttcacgaaccagccatttcgcaactctcgatgttcccaaaataataaaatgcaggattggtctgtcttcttttaatttttttgcactttcctttaaatctaccgcacgaaccggataaaacaaagggtgatgagatagcagctgttgtgctgctgttttatcatcatcaattataaaaacaggaatcgtatactccggaagaccacttaatgctgtgtcaatcagagcacgggcgatttctgaatcatttcggataaaaatttctatattcagttctttggtctctggtttttcatcttttattaactgtaataattatgtgaaattttatatctaattttcgattatccgcataaacactatactttcaagtattttgaagtatagaaaaccatttattttaccacgaatttaccacgattgaacgagccttgatatgacactaaaaataacatgggagatagtacaaaatatctgactatctcccgtctttcttaattttattgtaacacttaatgagtatcgtctttttctaactgttcttgcacaaatttaatactattctggataaattctttatctttttctgttgcaacttcttctaattgtttaaacaaagcaatgctttcatttcgtttacctaatacattaaatgcagttgcaatattaagataccatgtcatttcatctttcatatctttaggcttcatatccattgcaagaagtttttctaaaaagagttctccgtttttggtttcttgatattcttttacaatatcattgttcatttttctaaactgacgtcctctccgcattaaaacaaagaatacaataaagaaataaacaatagtaataacggcaataccgccaacgataatgcctaaaaaaccaattgttgattttacatagggaattactatgttcacataaataaatagtagtaccgcccaaaatagaaaggctaatcggataagccatttatctcttttttcatatattgctcttttattttttagattttcgggttcgtaaatcattttttcactcctttattactacatcactcagaatttgttgcattattttgttttttccattccttataatctttttttgtttcttgttgtcttttaacatcttccattttttccaaaatcacttctacctctggttgactgtgttgttcgggtaaagaatagaaaataaggttattatcgtttgtatatactgaaatattaaaaaccaaatcactttctacaatttcttgcatgatataggaaatttcttctgcatattctttatcagtttttccctcattaagatatatacttgtttctatttcatattccctttttttcagatattcttctacactttccttaccattccattctgttgtggttgtatgcccttgaacttcaatttgataacctcttataaaaggcttatcttgaaataaaggagttgcaagttcttttatttcatcagaatagtaataaacatggtaactatcctcgaaaagtccagtatttcgtgtatatacagtagcagtttgagaagaattttctttactggaaacatttgccctaatccagtttaatcctattttttcttctttgtacttcttcacttctgtaatgataaattcttcattgtatttgtcctttaatttggataagatatatttttgtgcttcttcactagagttaaaatcatgcgaataaccgctacaaccatttaatagtcctagacagagtacgcttgctataacgcctaataaaaattttttatatcgcataattgccacctcaatgtgattttataatttaatactgttctacaaactggaattttttgacactgttaataggcatgtgcttcaatatttttctaatttgattattttatacatctcccccatatattcccctattttgataatttagaattgtatgatacatttcttcatcatcatattcacatgctttagcttcatcagaagaaatctcgattctttttttctttatcatatgtgttccagcatcatattctaaataatatttacttttacacttaatcagtcttattccttcattctctttaactacttccatatttccctcattcaagtcaaagttactttagtttgcacattctttatttatgttcgattgaaatgcttattttacaatgtccgttttttctatcaaaccatttgtgatatttataaaatatcttttaccataaaaatctgttgctgtcagtattctattgttaagaaatatattttcaaatggtaaattacgtctgttaggctttcgattttctactttccatatgattttacaatctaaagaaattgcatatatattagatatttcatcaacaccaaatggtattgataataatataataacttgattatcaactaccttgatgtctcttatgtcgtaattaaacttaattgtatttttatcaatgcttaattcatttttgttgattttaataacggtattcattttctacctctaatcttaagttaacatagatttacaacttcaaactggaatttacatttataaatacttttcatagttactcaataattcaagataaaatggtcgcaagcaggtttggtcaacatcattttcaaattccaagacttgttccgagccaattctatcgcccttatggagataacctttaatagcaatgtgtcctctgttattacctacaaaggacatatacatatgttgtccataagattcctcaagtcttgcattgccttgcaaagtttcgtagatttgacataaatcttttccaagtttagccaagtcctttatatctatatccatagttgtactcgctgtaaagccattacttttaacatcaattttaagtattgtgtttgttgataaatttatatctgcttcaaagatttcaggctcaatacaaacaaaaaaattttctgtttcaataatatgtttcattatgtgtcacaccccaattccgatttgtcgctttcttcatgcccatattataacagttccatatatccaccacaataaaaatcaacataccctttaaatattttctgcattgaacatacacactttttctttcttcctcttgattacccaccacagaaaagaaaaagccctgtcaagagccttgccaccattggtggtgctttgcactctttactgggctttttgtttgctgtatcttccatgcaagaggaaattaaagacctctgttccatttcgcctttagataatcttcataatctccctcattaaagtctacttgtggagaagtattaggaatattttttctgttatctatatctgcaagttgacggaatatccagtcatcataagggttgtgatatttgtattctttcggctgttctctgtatcggtctaaccctcgcatttccttatgcactttcatcatgcgttctattttttgtcgttgtatcaactgtttgatttccataagttcttcaatttctacaacctcattagaaagataattactgatgtatctaatcaatatggtttccatgtaaaatctgtattcgttttcattttcaaaaaattcattttcagacagataatctaaagaaacattgaagtcttgttcccgtttgataatatccatgatatatggctcggtgtggtcgacatacttccattctcccgataataattcattgggcgttacacccagcacgtccattatcttttccagcgtatcaaaggtaggataattcacaccacgttcaatcttggaaaggctctgcatattgataccgattttgtccgcaagttcctgttgtttcattcctctgtattttcttatggtttgtatgttctctcctaagaaactgattttcttttcataatgctccataacttggtataaccgctcctttcgttgctttttttgacatttataagcatatcatacttaatctatatccaaaagtcaacaaaaacttcttgacaagtaattctaatggcgttattatcgtgttagatagagtgattaagcacgctagggtcaatcacacgcttgagtaagcatatagaatagatattttcactttgatagcatgaataggcatggactatcagactgaaaatcgggtttctgactgggctgttccgtttagccacgagccttacaaggctcgtgagcgttaagaacggggcagacacaggaagaaagggaacgcctttaggcgttcgtaaagggcgtatatgtaacaccgccctgcgcatacatgtcatagtacctagaaactgtgataaataaaggaaaaaacacgatttttaccccgcaaaaaacggggcatacgaaaggagtaatgcactataactacacacaaaaatttatccgttaagattgattacatcagtattgtatttgatactgcaaccgctgaagatatcatcatgcacattttaggtttaccgactgatattttcaatgtctatccggcaagcattaaatacaaaacctatcaagcacgctggcagattggagatatttatgtatcgggggacgcaaggaaaacagaggacaacccacaagggttaggctgttatcttgttatgaccggcagaggttgtgatgatattttccgtattctcgacagtaggaattatacctttggggatatgttcaaacattgtgagcgaagatacggacgggataacttccacttcacaaggcttgatattgccattgacgataaaaacgaaaagccattttttaccatagagcagataaagaagaaatgcgaaaaagaggaatttatctcgaatagtgagggctaccactttgatgaaagcaagtttgatgatttcgacaccgcaaagactgtttatatcggtgctggtaaatcgggattgtcctaccgcttttatgataaggataaggaagtctgttcaaaacataataagacgcttgaggaagtcggcagttggaaacggacagaaatgcaactgcgtgatgataaggctcatgcttttgccatgacattcaagggcagaccgctggaacttggggaactggctttcggactgctggcaaacaacctacgctttgtcgtaccaaacagaaacgaaagtaataagagcaggtggaaaacttgtcggttttgggaacgctttttaggggctgtggaagtcttgaaactgcaagtaccaaaacagcaaaattcccttgaagaaacacagcaatggctcacagagggtggcgtgatttccgctgtcaaaagtttttacttcttggaagaacatgacgcattaggtggactggaaaaagtgggaactatgcttgataaggcaagatacagcaattccctttccagtaaattaaccgcccatttacagaggataaaccgcaccgaccttatcccctatatccagtatgacacgaaacatgggaaagggggtatctgatgaacaacaacgatattcccgtatgggaaaaatacacccttaccattgaagaagcgtcaaggtatttccgtatcggagaaaacaagttaagacgcttggcagaggaaaacaaggacgctggctggctcattatgaatggcaaccgcatacagattaaacgccgacagtttgaacaggttattgacaaattggacgctatttagtgcaaatgagccttgtatgtgttatgatgaacacaagtcatatcaaggctctttccaacaaggaaaggagcagacaccatgaaagaaaaaagacgggataacaaaggtcgtatcctgcatactggagagagccaacgaacagacggaaaatacttatataaatatgtagacgcatttggaaacacaaaatatgtgtatgcttggagattgacacccacagacccgacaccaaagggaaaacgggaaaaaccctcacttcgagaactggaacagcagataagacgggatattgaggacggtatcgacagcacaggcaagaaaatgacgctctgccaactctatgccaaacagaacgcacagagggcaaatgtgaagaaaagcacaatgaaacaacgggaacaactcatgcggttattaaaagaggataagttaggtgctaggagcattgatacaatcaagccctctgacgctaaagaatgggcgttacgcatgaaagacaaaggcttttcctacaataccattaacaaccataaacgctcgttaaaagcgtcattctatatcgctatacaagacgattgcgtaaggaagaacccttttgatttcaagttaaatgaagtcctagaaaatgataccaaagagaaagtcgcattgacagaggaacaggaacaagccttattgtcatttattaagacggacaatgtgtatcacaagcattatgatgatgtgctgatactgttaaaaacaggacttcgtatctcggaactgtgcggtctgacagtagccgatattgatttcaagaatgaagttgtgattatcgaccaccagttactaaagagcaaggaacaaggctattatattgaaacgcctaagacgaaaagcggaataaggcaagtaccattaagcagagaaacgatacaggcatttcaacgggttatgaagaaacgcccaaaggcagaaccatttgtgatagacggacagggcaatttcctatttgtcaatcataagggcaagccaaaagttgcgattgattacaacgccttatttgtccgtatggtaaagaaatacaacaagcaccacaaagacaatcccttgccacatatcacaccgcatacgctacgccatacgttctgcacaaggctggcaagcaagaacatgaacccaaaagatttacagtatatcatggggcattcaaacattagtatcacaatgaattggtacgctcatgcgtccatagataccgcaaaatcagaggttcagcgtctaatcgcataaaagtatttaccacgattttaacaacgattgatagagaaaatataagaagatagacctagatatgcgaggtttaccacaaaagcaaaatgcccgtagagcctataaaataaggctttgcggacatttaagaagatataaaaagatagtcaaaaagacatatataatttcaaataaatcttctatatttttttcaaaatcatcatccaaaaacaaaaaacgttttgccgttttttcatgaattttcatttgcattaccgtcagatcaaactctgcaagccatctctcccagctttccgggatcgtcttttcgaatattttggcatatttattctttgtatttgaatagcatcgtcccactgtggcagtttctgcccgcataacctggggtataatccgactctcattatttactttccactcttcctgcgccagataaaatccacagttattactgattttcagataataatctgcagtttcatttgttgaagattgatattttcctgcacgaatatatttatataatacaaatgctgcctctccacgataacttttctctactgcaggtgttaaatatagaattttctcacagcctttgcagcatctcatcacatcttctccatcagatgccggattttgataaatgattcgtattttctctaacatagcttcagcatctgcattatttttccaaagttttgccggttcataagaaaacttaactgcctcttttaaaaatgcattacctgcttttttatcttttagctgataggctcgccttgcaagcagataattggcttttcctttctcgtatggattgtttaatgcaatccccagacattcttttagttcttccagtgagccttcttctctatgaagcatttcctgagctatttttatcgcatccgattcttcctcttcttccacaagcttcggcagaaataaactatgaagttttaaatcctgttccgaaaatttcgtattttccattccaaaactgcataacgtagatgcaataatcgaaaatactgcaagaatctgtgcatattcctgtttatcataaagctgaaataatctttccttgataaacaattcatctttttcttcctcaattttatcaatcagacgataaactgctttcgcaactttattttcctgcgtctctgtacatgcaggtactaatcgtttccagttttctgcgaattcctgaagcattggattttcttcaaaattataatcctcatgcgcctcattttttaactgaatcagataatcactcgcatccagaaaacgtttttttgcatcaatagtcgcacggcagactaaagaaacatattttccctgaactttcccacttcttacaaacattttttgatataaaccatccggaaaaatttcttttataaatgttttctggtctgactcattttttgtaaatttgacataaatatcttcatataattgtttccaagtaatttctatcttccacacagcgaatccccctgagttgttttatgatttcattatacctcattcgatgcataatatcttgcatttatcttataattctactcttttttctttcgatattaagatataataaaagcagattaaaattcaaaagggggaaattcaccatgacaaaacactacatagaatccgatattcgaaataattaccgtgccttaaccaaatgtttaattgaaaaacacttaagcatcaccacaatggaaagtgcaacttccggtcagattgcctctttaattactgatacggaaggggcttctgccattttaaaaggggcttttatcacctactcaaacgaagccaaaattatgcagggtgttccggctgaaattattgacacttactctgtctattcaaaagaaaccgccgaagcaatggcatgtgcctgtgcaaaagcttatcttgccgatattggaatcggtgtaaccggcacaatgggaaatattgacccagccaatctgaatgattctgttccgggtcaggtctattttgcaattaaaattcataataccgtttcatcttactatgttgaattagagccacagccgaccagactcgcctataaacttgctgtggcaaaagaagtatatgataaattaatcgaaatactggaaagttaaagtcaaacaggcagtgtccatccctttagacactgcctgtttgcctcatttcttcaaaatttgttctatagtattcaactcaagtatcttcatgtgtgccaaacaatttctcgcatttctatagtcttcaaagtggcttagaattccagataccgtctttttcagaaaatctttctttcccagttgttgtttccaattgttttccatgtaattgccggtaagcacgaggtccgctgccataatatttttcaaaggtagctgcaaagtgttgtctgctgttataaccggtatgaaatgcaatatcagtaatcgttaaagaactgttgattagcaaaaatgctgcctgctccagtcgttttcgattaatgtagtctgtaattgtacagtgcatttgtctggaaaatagagattgcagataagatttattgattcctgcatatcgagcaatctcaggaattcgaagttcttctgttaagtttttacgaatataatcacaggctttttttaaataaagagctccggttgtggattggccttgataaagacatcttgagagttctaacaacatccgaaaaaaaagcagacaaatcaaataatcggaatcaaatttctgaagatgtttttgacgctgaagacgtaaatcatccaaagaaagtgtcaactctaattgagaaatcaaatcttttaaagagtatcccagattataaatatctgttccagttaaatgagagcaggaatctttgcaaagtttcaggaataaatcactctcctttataagttcagataaattgatttttgttctttcttcctgacaggaaaattccaaattcagcatggaacaaaattggtcttcttcaataaataatcggtgtgggagatttgcatcaataaaaatgaattgatgagcttctaaaaggtgcttctctttttcaataaatacttcacagcaacctttggtcacatacatgatttcaaaacttggatgagaatgaaggttcatcttataatcactaagagaaagtgcataaaaagcagtgagtgaaatgtatggttttgatggataatacaaattcatgataaaaattctccttaaataaaatacggtaatatcttgcattttttaatgaaatcaacaatagtttacacctaaaaaaaatgctttgtctataatgaattcatagataagaacgatagaaacaggaggttttatttatgagttttaaaatagcatttatcggagcaggaagtcttgtatttgcaagaacactttttacagatattatgtctgtaccggagcttagaaaagcagaaatttcttttacagatatcaacccgtataatctggaaaaaacaagagcactttgccagagagaccttgatgcaaaccaaattccggttacgattcaggcaacaacagacagaagagaggcatttaaagatgcgcgttatatcataaactgtgttcgtatcggaggactggaaggatttgaaacagatatcgaaattccgttaaaatatggagtggaccagtgtgttggtgatacgttatgtacaggtggaattatgtacggacaacgtgtaattgctgcaatgctggatttttgtaaagatattcgtgaagttgcagaacctggtgcaattatgttgaactattccaatccaaatgcaatggcaacctgggcatgtaataaatatggaaaagtaagaaccatcggattatgccatggagaaattcacggagagatgcagattgcagaagtactgggaattccgagagaagaactggatattacctgtgccggaatcaatcatcagacctggtatatttctgtgaaacatcatggagaagaattgttagaccagattcttcctggatttgaagcacatgaaaaattcagagaagaagaaaaagtaagaattgatatcttaaaacgttttggatattattcaaccgaatcaaatggtcatctttctgaatatgttgcatggtatcgaaaacgtccggatgaaatcaaggactggattaatctggataattggattaatggagagactggcggatatctgcgtgttacaagagaggaaagaaactggtttgaaaccgattatccgaagattttagcagaagaaccaaagaaattagatggttctgaaagaggaaaagaacattgttcttatatcattgaggcattggaaaccggcaagaaatacagaggtcattttaacattatgaatgaaggctgtattacaaaccttccgtctgagagtgttgtagaagttccttgctatgtagatgggaatggaatcagtattccgaaagtaggcgaccttccactgggatgcgctgctgtttgctcacagtctatctgggtacaaaaacttgcggtagaagcagcagtacacggagatgtgaatctgttaaaacaggcagcattaatggacccgttaaccggagcagtttgcaatcctccagaagtatggcagatgattgatgaaatgttagttgcacaggaacagtggctgccacagtacaaagaaggaattgcacaggcgaaagaaaatcttgcaaaaggaaatctgattcctacaaaagaaggatataaaggtgcagttcgcttaaaagaaaaaacggtagaagaagtagcagcagaacatgataaaagaaaaatcactgcataagataagactatagttagagtcagacagtgtcaaaaagcgacactgtctgattttttataatataagagtaaagcgttcaatcaacaggtataataaaggtgctcatttaataaaaaacaaggactgaatttccaatattcacgaaattcagtcctcactttttacttactcaatttatacagttttgcatcatgggaatccactcccacaatcaactttccttctatttcacctaattctttttgcgcccataaatcacgcagtttataacttccagttaaatcaagcgcccgaaaatcaattgcgaaagtctcactccagtttgtcgtattaaacaccgcaagaaaaacatttccttcttcatcttctgcctgccatacaatcatgtctccctgacggattgcctgatgtgcattgcggcttgtctttaatagacttaacacttcttcatttgttaaaagtgcttttgtccattcatccatatccgtaagttcacagccaatcataagtggcgaacggaaaatattccacagagtgagcatagttcgttgttctgcctttgaaagtcttgtccatctgtcacttaatccatgttcacaacctctgatagaaatatgtccgaccggaagcatatcacaatccgggaaacagccttccgatacataaggtgcccagttattacatctgtcaaacatttccataatatcttcccaggaatcccagaagtcattggtgattctccaaagatttgcatattttcttaaatgctcggctttctctaccattgccggtcccggtgaaagacttaagacaatcgaccgtccacatttttcaatcgctctgtggagcatttcaatttcatccccgccatactgcaatgttccttcatcgttgatgcgaccatattttacacagatatcatccactttaatataatccactccccaggacgcatacaattccaaaatagaatcatagtattcctgtgcgccgggttgtgttgaatctacaccatacatatccgaattccaacagcaaattgaagctggatgtgcaacctgacgtgccgtataggaagttcctttaatcgtcacattttttgcaactgcctggcgcggaattcctctcataatatgaattccaaacttcaatcctttcccatgaatataatcggcaatctctcgaaatccctttcctcctgctgccgatggaaaacgattttcagccggaatcagtcttccatattcatccatacataaatccgcaaatttatgataatgactggaatccgctgtcggttcataccactgaatatcgcagatgatatactcccagccatatttcttcaaatgctctgccatataatccgcattttgctttaattctttttctgttaccgatgctccataacaatcccagctattccagcccatcggaggggtctttgcaaaatcatttttattcatacttttctccttctattttaagtcaatctcaaacaaacgcgcacatttttcctgtgggagttctacgcacaactcattctcatcataacagaatttacaatctacggtatccggatagatgaccgatactttttcaatttcttttccaaagtccagtggaatcttgacgtttgcagtttttggtgcaagcactgcaagatatactctatcctccgttttaattccgtaaaccagctgtttactttctaaatcagcaaatccaagcggaaaaatcggaacgccatcctttattccatcacgaatctgtttataaagtgcaattccttctgccataagtttaagattttcctcactcattttccataccattccacttatgtatggacgaagcaggagcccatttaccatgttataaatgacatgctctctatcatcttcataaggataaacccacatacccgcctgttccggtgttactgcacttgcaacatttactccaatataagaattgtaaatgtaatccgtctggtcactggtagactgaaggcttaaaagtttcatcattccataatccattctctgtccgccagaaccgcagttttcaattacaaggtcaggatgtgctttaaaaatttctttataccattgatataaacataaataatgctcatggattgcatcggaacagctgtcagaatttaactcacttccatatcccatcgtaacattataatccactttgaaatatccaactccataatcctcaatcagacggtctacaacttcacggcaatattttcgaacttccggatttctaaaatcaagtaaataccgtttattatcgatatgacgttttccatgacggcagatgaaccagttatctggaagtttctttgcaagttcacactctactcccatcacttcgatttcaagccagagtcccataaccagtcctttggattttgcatagtcgcagacagatttcattccgtttgggaaacgttccggtgactctttccattcgccaactctgtcccaccagtaccctttatcataccagccagcatccatacagtaatactcacagcccatctcagcagctttatcaatgatttctttttctgtactttcaatcgggtctcccatcagacagttcatataatcattaaatacaatatttaatttcttatcatcgtcattttctcttcggattgctctacgatactttgtcaattctgccattacttcattcaaagaaccatctgcaacaccaaatccaaccggtaccgtctcaaatgtgtctcctggttttaaattcttccaccagccattttccatctctgtcggaccgctaagcgcaagatacagattttttcccatagaagaaccatactctacaagccactgaccggaatgttcaatctggaagaaatacgtttcttttgcttctgtgtcttcacaaattcccatcggaagatattcacaacttgaccaggagcctcttcctccatagcagtatcggtttaacccaaatcccggagtgttaaatccatctaccatcattccatttaaattcaactgttttgcactgtcttttttccactgtgcttcacagcaccagctattatatggagtgtaaatctgtgttttatcataatatggaagtttcccatttgcacaaagaccatgataaacaaaagaagacacatactctaagccaactgcttctgtaccattattttttacttctgtccaaacctgtgctgctgaaatcccatcaaagaactgcatataataactaagttccacaccataatctgatttcgtatggatgattaactgctgacccttctctgctttttccaacgtatgatttacataatgaaactcttccgatgcactacttaaactatgtttatagccatgcatattcctgcttccttttccggtaagctgaatctctgtaatcgaataagatgcctgttcatctcttggttcacgatttctgtctggttttccagcggttgtaaattgttttaattcaacgattccattttcacgaatttcaaagataacttttaatccgttctcctcaatgcgaatttcttttgtctccataatcgtgttcctttctttttcctttcttttcttttttattttattaatcataataccaggcaccgtcttctgttttccttgcctgtttcatatatttttgtaagattttttccactaaaaatgaagaaacccaagcatatactccaggaacaattgccattaaaagcggaaacaaatagcaaatcattcctgctgctcccaaaagcagaatcagtaatattgtaattggaaaatatttcacggacatatgtaatgcatactgaaactgcccaacaatgctcatacgaaatcttgagagtacggaaaaaatatacagtactgtaactgcaaacggagaggcaagtaccattcccgatgcaacaaaaagatatggtgttctctcaaacattccactttttgtaactacacttacttgaactaccccaaccgactaacgtcggatggggattcctacgggctttcgcccgatacccactcgttcagctcatgggtgttccaacagagaacaaacccgttttcaggaatgtttttgtatgttggcgtaagtcagatattcccgtccatccagctccctgcccactcattcaactgactagtacaaaatgactggtaagaatatccgaatatttcttctatttctatatttttgtatttcgctttttctttcttctatcttcttttatacatactcatatcgattattttgcgtccattttttcatttccgatgcaatgctttttaaagttcctttttttctttcttctaagacttcataaggcagttcccggtaaaaactatggggcgaaactccacgaaatgcttttgttaaatgtttccatgctggaatgatactcacaatatctgttccattttttagtttttcttttgccttttctggtaataacataagtaaccgctcatccggtaacagtttttcccgaatttccattccttttaatccaatcgtatacgatgctgcttcatgaatggaaagtccaaatggtcttaaatacaaaaacttccccatttggctggtataagccggattcattttatagattccaaaactttgtttataggcttgattttccaaacagctcgtcatctttcggtaagcaaacaaagaagcatgtcgattctttttcttacatccatacttcattccgtgttttgcaagcgtggtatccaaatcttccataataagcggtttcttccgttcggcgcaataacgtcctacctttgccatcactcttccgatttcttctgaaatctgcccttttgttttcaattccggtgaaaagcgaatgactgtcccacccagacggtttcctttttcatctaattctgaaactgctacatggtcataattcaaatcaatcgaaacacagcctttttcaaaagattcattgcaatatttattttccagtaaaagcgtcaccgatacaatcagatatcttcgaccagttttctctcgtttcaactgaaaattataacaaatcgcttttcgttcctgtttttttgcctgaagcatttcttcccaaagttcctgttgccttgcaagatggaactttttaaataccgtttcttttccatccatacattttacaatcaaatttctttcttcttttctgaccagaaagttacagttttttgaagtatgacgtcctggaaggctcattgaagcatggcgagattcaaagaattcctgtttccactgttcacgatcgacttttggattgtcttttttttgatattgttttcttccaccaaatacaattctcttcggcagaaacttttttaaccattccagcctttgaatggctcttttcttagaagattccagtaatgcaattcttgttttcaatcgacgaatggaacgttctatttttctttcgtattcttcgactggaaagtatgttccattcggaagaaaaatttggtttcgttccattgtaattctacactttggataaggacgctcccagattccgcttttaaaataagttcgcaaagaagatttgattccctgcttcttttccaattcttcctgtgttcgttttatcttttgattccgtgtctcaatgtctttttcttttgttctctgatacaatcgattcaattccttttgagaagaaagaacagaagaagcataagtatagatggcacaattataatagtccgttgttccatagttccttttcagccaggagctgtatgtttcttctaataacggacctctttttaaaaaggatttgtcatacaagcagttatagagcttgattttgatatgattaaatcgttccatcgtctgaatcaaagactctacgttctggatttcatcctcatccagataataccgcttatctgcatttatcgttctggttaactgcatgaaaacactccttttctcaaaacagtttgtcggttgaaaatataacaataattgaaataatcctttatttatagtataattatagcacaaatcaagccgttttacaacatcggttattttaaagaaaggagaaatttatggacaacaaaacttataccagaaatgctcattccgtctgctgtctgacctatcatgctgtttttgtcattaaatatcgaagaaaagtaatcactccagaaatccttgcttttatgcgtagttacacagattacttaatttcacagcgttatcatggaaaacttttggaatttaatggtgaagaagaccacatccatatcctatttgaacttccgccatccgctgcaccttctgttattatctgtaatttaaagactcagctttcaaaggaagtccgaaaacgcttctgggaacaaattcacaatcaattatggaaagattctttttggagtgacagttacttcttatcgacaactggcggtgcaaatttggaagtattagaacaatacattcaacaacaaggaatcgaaaaacaaaaacggaaatacgttcatcacaagaaaaaatgagcattcatccccaaccgactcgtcggatggggatgaatgctctataatagataaaattacggcatataccagataaaatagtgttataccaattccctgctttaaattttctttaaaagaatgccagaaagcaattgtgacagtactatgttttttccttacaactttaacaattgtataataaagtgctgcacttgccggtcctatcgtaataatcggaatacatgctatcagccacaaaaatcctgcaattatcacttctgaaatctgttctgcgattgacacaatcggagagtcctctgataatttcaccctcattcctcctgttttttctcattactttattttatcatttttctaaaaaagctaccattggaatctatccaaaggtagctttttttactttttacttaatcgcactatctacctgaccttggataaaatatttttgcaggcacaggtaaacaataatcaatggtaacataccgattactgctgttgctgctgctgcaccataatcatttgatactgctgagaagaacgttttaatgaccaacgtaatggttctcatggatgtcttctgcaggaaataatatgcataagtatattcattccatacactaactccttgaaggataataactgttacagttacagttttaagctgtggtaaaataattttaaagaaaacctggaaattacttgctccatcaatggcagctgcttcatcaagcgcaaccggaattgatgaaataaagttcgtatacaagaagataacaagtagaagtccaaatgcacttatgttgttagacatctttttttctttttatagataaaatttaggggaggcagatgaaccgtttcgactcatctgcctcccctattagaactgtcattaaccgacagccccattctattacttcgaccaatatcttttgatcaaccgcaacatattttcacttctatacttccatttttttcatttcttccaggaaatcacgaatataagctactgctaaatctaaagcttcctgtcccaactcagctgaagattcctttggatcaaaaggaccaaaccaaccactcggtgcgatttctttagtatctcttacaagacgcacaattcctcccttaaaattgaccgcctgaatgtaagctgctttcatattttcggtcggatcttgagcattaatcggcttgctcagttccagatgcacagaatccggagcaattgccatcattgcagaagtttccagaacatcaccatgaccaccttcaaattttttgtctaactgagctaccagactccaccaatcaacgcttgcacatacaccacctttatgatagacttcaagcgctgcacgatcaatagacggtgtatttccgccatgaccatttaaaatcacaaagcgttttgctccatgctgcataagagaatccataataccatggagtaccaaatacaatccttcatatccgatattgatgcttccctcaaaactcaaatgatacgggcaaacaccatacggaacggttggtgctacaattacattttctacatcttccacgtgatctgccagataagacggaaccatgaaatctgttccaagcgcactctgtgtaccatgctgttccgtgcttcctaccggaatcacaataatcggatcttttaaaaaggcttcctttgcctgtactgttgtcatttttgcaagatacattctctaattcctcctatcatgctataccataaaatggcgttcaattgtctcctgtggcggagctttggtaaatttacttacaataaccattacaattgctgaaatgatcgttgttggaaacaatgcatggaatcccaaagcaagtgcttttaccgatggatttaaggtaaagagtaacaatgagatcacacctgttactactgctgcgattgctccctttgcagttgcttttttccaataaataccaaacaaaatcggtactacaaaaattgccattcctgagaatgcaaataagttaatttcaaagatactacctggctggaatacaccaaagcagattaccaaaataccaattataacggttattactttagaaagcttcataacactttcatctgtcgcatttttattaacgagtttttggtaaatatcacgggtaactgcaccggtagtcgttaccaaaataccatcgatggtagacatacctgcggctacaatgccggcaataaaaatagaagctaaaaatggattcaaacctctttgcaaaatcattggaacaatctgatctgctttctcaatattctgaattgtagcaattccgtttacaccggcccattcaatcagagttgcagagaaaaacatacctgcagtacccagaaggattgctttaaacattgttttatgatctttcattgcaaaaaacttagtaaacaaatgtggctgtcccattgtaaagaaggaccacaacacaatattcgatacataatatgtccaaggcatataaccatttgcacctggaaacgtcagataagcttcattcatactatggagcgtttgattgatattagagaaaccgcctcccattacgatagaaaccacaaatgtcacgattgcggtcgcaatcatcaaagaaccctggattacgtctgtcatcatagcaccctgcataccgccggtcatacagtacaagatcacaataattcccattccgacaacgcctacccattcaggcagtccggtaaatacatgtacaataacacctgctccgataatctgtgctcccatcatcggaatcaagaaaaacagcatcatgataccaagcacaccactcataactttcgagtcataacggtctgtcagataatctgccattgttaagaaaccatatttgtgtcccagcgtgattaacttacgaccaatcaaaagcgccggcaaaatcatgcaaaatactgcacccggtacagaaattgccattcctgcatatcctacgccataaattgttcccggagttccaaggaatgttcccatagaaaactgagtagagaaatatgcgataccactcactactactcctgcttttccgcttaagacaaagaaatctcccaagctgttggtcttgcgtcctgcataccaaccaataaatgccataattccaagataaagtaccaacaccgtataaaaaggaataggtgacggctgaattgctgctccattcataattactttttctcctcctcatcataggtgtgatattcttttcgtttcatacacatgcgataatattttataatcagcgcaaatgtaattgctgtgtgcacaaaccatccaaacaaaaaaagcggaatcccaccaaatgcagggatatatgtctcgctataaaagaatgggaacggaatcataaggattacaaacataaataagaaaataatcaaccaagtccgttcaaagtgctcttcaaactgctttttcatagttttgccctcctcttttttcaatttctttcagttaagcatatactttactttctgttttttattatacatgctataatagttttgtaaagtcatcacttacatttttgttaaatatcacgaaacttttttaaccctgacgacgaaaggaaactctatggacattttagaacatattcaggaattatatccaaatcttaccaaaaagcaaaaatcgatagcagattatttaactgctaaccctgaagaaatcagttacattactctagcgcaactcagtcagcaaactcaagtatctgaactaacgcttctgcgcttttgccaaaaacttggctgttctacctttgtaggtctaaaagaacagtttcgagattatacccagagaatgattcgtattgcttcctcctcttcttactttattccggaactggagaccggtgaagcacctgagcgagaacgcatacttttaaaaatttgcaatcatgaagcaagtgccttttccggctttatttctgatttacctttcgattccattatcgctgcttctgatgaaatccgtcgcagcaatcgaatttttatttttgctcacgatatttctaaagtacctggcgaatttttaaaatctcgactcctaattttgtattttaatgcaattttaattgatttatccgatttagaacaaacacaaaaaactttacgtcagcttaccaaaggagatcttgttatcttcttctcctttccacgctactattttccaattggaaatattgcaaaaaaagcctctgaagccggagttccgattttaacgattacggacagtgatgcctcacctgctgcttgctatagcaacttattgctcatttgtcctacctctacagagctgttttacaattcaatgacaattccaattgctatgctaaatattttagcatcctgccttgtcattgacattatttcaccagccgaacgacaaagttttatcgacacgttatcttcttaaactttttaaccaaatcaagtaagtcccctgcttcaattgtgaaaagcaataagcaggggtggggacttgcttgtatcatgagggggcaagtcccttctgataagctgcgtagcagctatttggttatgagcaagtagcaaagcggattgcgaatatccacttgactctctttaaaaaacggagacatcgattcaaaattccaaatcgatgtctccgtttttcattatttttcataagtgcctttttgaagaatctttccctctttcataaaaagctttccattagccacaaaagcatccaactgtaagtctttatcaaaaagaagaatatctccatctgcgccttcttttattaaacctttcttcggcaataaatcaagcccctctgctacctgactcgtcatataaggcaacgcctcctcaagcgacatttcaagttcttctatcatatactttaattccttataaagcgcatccacaccagaaacaccaatctccaaaagtgttccatcttctgcataattggaccaacttccatgaccatccgaactcatagtaatgtgctcggtagaaattcctctcctctttgcttctaatacacacttacccggagaggtgtgcataccgcaagtcaaatccacatatccgcctttttgcaagagttcatatccttcttccatcaaatttttattacgatttacatgcgtcggtctaaaaattcgcaccggaacagaacttgtgtccaatgcttgaaaaaccggctgcaaccctgccttgtcatctcccatatgaagtacaacgattcctggttttccgctaagcattcctgctactctagccttactggcaatctgaatcagctcgtcttctgtcacattcggtgcacgatgatctgaaatagcaagcttcacacccaaaatttcttttacaaacacaatatctctgtcgatttccccagtaatcgtcggatttggaatcccataagctccagtcagcatatatgcacttaccccttcttcacaaagtgctctggtttttgcatagagattctctacacttcttgtaattccatcggttcctaaaagccctactaccgtagtaattccattttctaccagctcagaaagctgcaattccggcgttcttgtatgaaaacttccttctccgcctccgcctgtgatgtgcacatgctgatcgatgaatcccggtgtcaaaacttttccttttgcatctaaaacttcacaatcaatcggcagcggaccaatttcgtcctgaatcttttcaatttttcctccacagatcagtacatctttttttcccaaatattttggcgcatatacttctgcattttttattaatagcatctcttaccctcatcttttctttttgcttttcacagttccaaggaacatgcatcaatttttttcaattcttcttcactaaatgatgcgctgtttaatactttcagattttcaagaatctgctccggacgggaagctccaattaaaacacttgttacaataccgtcacgcaaaatccattttaatgccatctgagcaagactctctcctctatctgccgaaatcgcatttagactgcgaatgctttccaaacgttcttgtgtaaactgcttcgcatgtaagaatcgtccatctgtatttacacggctatcttttggaatcccatttagatagcgatttgtaagcattccctgtgccagtggactaaaagagatcactccttttttctgctctgctgctgcttgctttaaaccatttttttcaatttctctgttaaaaatattataagaattctgattaataataaacggacaatgtagttcttctaaaatttttgccgcctgtttcattgtctcaccatcataattagaaattccgacatagagcgcttttccgcttctgacaatttgcgccaaagcttccatagattcttcaagtggagtttccggatccatgcagtgatgataaaagatatctacatattctaatcccatacgtttcagactctgatcgaggctggcaatcaaatatttccgactgcctcctgttccatacggtcctggccacatatcataacctgctttggtactgattacaagctcgtctctataagcataccactcatttttcaatattttaccaaaattttcctctgcacttcccggttgtggtccataattatttgcgagatcaaaatgtgtaattccatgattgaatgcagtaaaacacatctgtctcatattttcatagacgccagtatctccaaaattatgccataatcccaaagagagttccggaagcataagaccgctggtaccacagcgatgatatttcattgtttcatagcgtttttcgtttgcctgatacatctttcttctctcctgatttttactttactttatagtttatcaaaagatgaaagaaattgatagacgttttctgccgatatttttactttctctgctttctttataattctgctccgtttgtctctattacatgtttataccaaaatgctgagtctttcatgattcgtcgccaatacctttgccacctggtaatccacatcattttgatattgattattataacaataaaagattgcaacgaaatttaggagtattaactccaatagcaaaatacaaacaatatatgttggtagcataaaaaaactgccaccagattcaaaactggtggcagaaataactttttatttttttaattgtctacttgacgggaagcagttcaatctctgctctttacactgtcttttcttctgcctttactatgcccttaaatatagttttaatgtcctttcaaattactttcttatcaggcattagcaaaaggagctccttttttgtttttacatatccaaatgcactgcaccagtctggcgaatctgcatcacataaatattttcttctcccatataaggagtcatcatctccacatatttcggtgttaaatcttttggaagcactgctgcaatgacacctgcaaatccaccgccatgaactcggcagtatcctcttccttcttcttcgataaataattcggtcagcgcaagtgcaaccggaactgcctgttctgtctcatcttttgttgcaaagcagttctgtaaccatttccaggaggaatttcctgattttgtaatgcagcttaagaaggttgcataatcttcttctttgattgcttttactgcagtatctactcttttttgttctgcaaagaaatgcagggcacgcattactgcacgatcaccggcttcttctcttactttattaagatttgccataaattctttttcgtccacatccgcaagcacttcttttccaaatacctttgcggcacgtttcatttcaaccggcactgcggaatattcttcacttaagtctgcatgaccttttcctgtatttacaataattaagtcatatcctaacttatcataaccgaattccactttttctacttttggcatttcctctttgaaatcaatcgcaatgactccgcctactgcacatgccatctggtctaacagtccggactgttttaaccaatattcatgttctgcatactgtccgattttcgcatattcaacataatcaatttttccttcattgctgaagtagttcatgattgcgcaaatcagcatttcaaaagacgcagatgaactgacaccggctgcaccgattacctctgttgtgatataagcatcaaatccttctactttgtatcctttttttatggcacattcaaacataccgattaataaagataaggttcctttgcatttacattcagaatccagattttccaaatcaatggtaattgctttgtatccctcactgattacatgaaccagagaagttccgttttttcttgctgctgcaatggtatccattgcaatgcttgcagttaatacttttccatgattatggtcggtatgatttccaagaatctcggttcttcccggtgcactgaagaaatccacttctccctcgccaaaacattctttaaattttgttgccagatgttcatatcttgcctgttccttcgctaagttttcttctccataaacactgctcagtacgcttacttctttttctgattcaaacattcccatttttttaccttcctttattgtatttttcttttctttacgttcacacttgtaagttttgttacttgtattataatggagttatagacactaatacaaggaatatcatggggattatatggaggatattgagattttatgcaaatacagacgaatcgaaaccagagggaattaaaaagccatggagatgtttctttcccgattctggtcagccatgagagcatcacatcttatgagttaaataccttttcctggcactggcatcctgaaatcgaattaacattaattgaagagggcgaaatgatgtatcagattaacggacatgaaatgcatgtccaaaaaggagacctactgttttccaactgcaatgctctgcacagcggtcactccattgacggaagagcctgctactactggagtattacttttgattcaaaattaatttatggatttgaaaacagtctgattcagaccaaatatgtcgatgccgttgtaagtgcaaaagaattttcctctcttttattggatggcagtgaatcctggcatcacgatttaaaagaactggtctgtgaattgatctccctttcctccgataaatccgatttttatgaaatcaaaattcaaatgcagcttacaaaaatctggctgatgctcctcgaacacagaacctcattttctttaaatgaaaatgctctgaatccgaaaacatcagccagattaaaagccatcttaagttttattcacgaaaattttgaaaagaaaatctctctcgatgatattgccaactcggttcatttatgtaaaagcgaatgttgccgtttttttaaaaaacacatgcaggaatcactttttgattatcttctgcgttaccgaattgaacaaagcattccttatcttaggaaccctgaatattctatcaccgaagcagctctttgctgtggctttagtgacgccggatactattcccgcatgttcaaacgctataccggaatgtccccaagagattaccggattggtctgtttccggattacgacaggtaacccctcatatgtcattattttctttcctacactttgtaggaaaactttgaatttttccccactttctgcggcttgttatttctctctaccctgctaaaataataaatataaaaagcaggaaacgaaagggaaatccttaattatattgtttcaggaggtgtttcatttgattattattggggaaaaaatcaatggttccattccatctgtagcaaaggcaatcgcagaacgtgattccgaatttatcaaagaacgcgcaagaaaacaggctgctgcaaatgccacatatattgattgttgtgcatctgttccggaagccgaagaagtagaaactttaaaatggatgattgactgcatccaggaagtaaccgatttaccgatttctgttgacagtccaagcgctgacgttttaacgcaggcatataaattctgcaaacgtcccggaatctttaattctgtatccggagagggcgataaaattgacaaaatctttcctcttatggcacaggaagaaaacaaagactggcaagttatcgcactgttaagtgatgataccggtatcccaaaatgtgcagccgaccgtcttcgtgtctttgacaaaatcatggcaaaagccaaagagtataatattaatccgagccgaattcatatcgacccgttagttgaaatgctttgtacttcagaagacggaattgcaatgaatatcgaagtcatacaaactgtccgaaaacagtatccatcaattcatattacagcagctgtcagcaacatttcttttaatcttccggttcgtaaactgattaactacggatttttaattcttgcaatgaatgcaggtcttgacagtgctattatggacccaaccaatcgtgacatgttaggtcttacttatgcaaccgaagctttgcttggcgaagatgaattttgtatggaatacatcggagcgtacagagaaggcttaattggtccattaccaaaggcttaactctaaacatttgaaaatatattggaaatttaattcaatcgaaataatagggaggtatcactatgagtaaacttcaagatgttgaaaatgcagttgtttccggaaaatctaaattagttgcaggtcttgttcaggaagccttagacgaaggatgttccgctcctgatattttaaatggaatgattaatgcaatgggtatcgtcggtgaacgtttcaaaaaaaatgaaatctttgtacctgaaatgcttgtcgcagcacgtgcaatgaaaaaaggcgtcgatgtattaaaacctcatcttgcttccggaagcgctggtgtttgtggaaaagcaattattggaactgttgccggtgaccttcatgatatcggaaaaaatctggttgccatgatgattgaaagtgctggatttgaagtcattgacctcggagttgacgttccggttgaaaaattcatcgaaaccgttaaagcaaatccagatgttaaaattgtcggatgttctgcacttcttaccacaaccatgcctgcattaaaatctacagtagaagccttaaatgcagaagacttccgctctcacattaaagttatggttggaggtgctcctatcactcaggaatttgcaaatgaaatcggcgcagatgcttacacaccggatgctgcaagtgctgcacagaaggcaaaagaactggtagcttaatttctatttgatgtttgtcatttttaatccttacactttaccaaaagaggctatgtactttcatggcctctttttctacttttactgcctagatagatttactgtttttttaatttctgctataattgatacaaaatgcacgacaatttcaaccttatttattattttgacatttattgggggaattttattgaaactttttaacattcactttatcaatgaaaatcaagtaatccaggtaccagaaaatacaaccctgttagaagctgaaatcaaagcaggacttataccggatgccccctgcggaggtcagggcacttgcggaaaatgtctggttcagataagagttcaggaaaaatccgaacttgtaaaagcctgccagacaaaagttcattcagacatagaaatagaaactctgaaacatacttcaaagcattccattctccatgaaggtttttcccgtccggttcttttaaaacctgccctctcctgtcatgcaatcaaattagaaaaagcaaaacccggagaaaatgcttctgactggcagcgccttactactgcactcacaaaggtttccgcaactgacatgagataccttgaacctgacttgacctttgtttcacaaatttatacgttgcaaaaagagaagatttatgccgtaacccttaagaaccatctgcttgatttaaaaaatgctcctgtcattccttatggtgcagcttttgatattggaactacaaccgtggtcggctatcttattaatctgaccacgggaaaagtttgcgctgttgcaagcaccatgaatccgcaggttcaattcggtgcggatgttatcatgcgtgcaaactatgcattagaacacggaaccaaagaattaagcagttgtatccagactgccattaacaaactgattggacagcttacaaaagaagcagagattgaacgaaatcttatttatcaggtcatcattgccggaaatacctgtatgcaccatctgtttcttggaatttctccggcatctctggttcatgcaccatacaatccggcagtcagtcagatgcttgatttaaaagcctctgatttttctctttctattcatccaaacggacgccttatcatgttaccggatattgcaggatttgtgggagctgacaccatcggctgtctgctctgtgtccgcccggatttaaaagaagaaatcacactcaccatcgatatcggaaccaacggtgaaatggttcttggaaatagagaacatctcgtcacctgttctactgctgccggacctgcttttgaaggtgctaaaattgagtgcggcatgcgtggcgctgctggtgccgttgaccatgtacactttgaaaacggtgattggaaatacacgacaattgaaaatgaaaaacccgtcggtctctgtggttccggattgattgatttgactgccgaactgttaaagaatcatctaattgattcttccggaaaattcatccagtccaaatcttcttttactttaattgaaccagatgaaagccggaattttaacggtgtctatctgacccagaaagatatccgcgaagtacagcttgcaaaggctgccattgcagccggaattgaaagtctggaacaggaacttggaatcaccgaagaccagatttccaaagtatacatagccggagcctttggaaattatatgaatccacaaagtgcctgtgaaatcggaatgattccatttcacttaaaagataaaatcgttccagttggaaatgctgcaggagaaggtgcaaaaatcgcattgattaacgaagaggaacttttatacgcagacaaacttgctaaaaagatttcattcgttgaacttgccgcatcggaagattttcaggactgctttgtcgacaatctggaatttcctgatttttcttaacacatatatgctctcggaatctttatctttgccgataagactccgagagtacataaatcgaatagaggtgtatctctcatgattaattacaaagaattagaagatatcggtcacaaaacgggatttacccacattgtaccccttgactgtaagaccattgaacttttacctgaagtccgtcagatgtgtcaggctgatacctgtcacatgtatgagaaaaactggagctgtccgcccggatgcggaagtttagaggaatgtcgtcaaattatcgggcgctacacccacggaattattgttcagacagtcggggacttagaagacgagcttgatggtgaaggcatgatggaaactgaacatcagcataaatctcatttttatgaaatggaaaaaatattaaggcaggtctggccggatatgctcgctgtcggagccggatgctgtacgaaatgcaagacctgcacctatccggatgctccctgccgttttcctggaaaatcattttcttccatggaagcctacggcatgcttgtcactcagatttgcgagagaaatcatttaaaatactattacgggtcctgcaccatcgcttacaccagctgttatctgctagagtgaacttaatacacaaacacaggaggaatttttatgactacacttgaactgctaaaagaggccatcgaagtcggacatccccgtgatgcacaggctcttgtctaccaatgtctcgaagagggcctctcctcctcggaaatcattgaccaggcaatgattccggcaatgaaatcagccggagaatactacaaaaataatgatgctgatatcccgcggattttatctgctgccagaagtgtgagaaaagcctatgatattttgcaggaaaaattcggttctctggaggatgaatcgcttggaaccattattcttggaactgtagaaggagatttacacgatgttggcaaaaatctggttgctttgatgtttcgaagtgccggattcaaagtaatagaccttggcgtcgatatttccgaaaaacaatttttaaaagccgtaaaagaaaatccggatgcctctatcgtctgcatttcttctctgcttaccactgcactgcctgaaatgcaacaggtcgtaaaatcattaagaaaacatgacccaaaacataaactaaaaattatggttggcggcggcgctgtaaccgaagaacttgcaaaacaatttggagctgacgcatatagcgacagtgccatagaagctgccgaaaaagcaaaaacttttattatttaacaagcaacggagcttaaattttatgaaattatctactgaacttctttttgaaaaattacagaccgaatttacaataaccgcttacagaaatttatcaagtgcggatggatttttgcgcccttttttatatgattccaaaccgcttatcgattcccgaccgatttatgaacccctcgataaatccaaaggaatcactccgggacacgtctgccttgcccacggaaaacgcttagaagaatttattcctcatatttttgaagaacattttttagttttaaccggtaccaggggcgacgttcaaaaactttcttctgctgtctttccttatgtcgttctttctgaaaatacctctttaagcagtgttttaaattttctgcaggacatctttgatttttatgatgactggagtaacgaattaaatacttttttattaaaaaatgatgatattactctgcttcttcacaatgctctcaaaatttttcaaaatccactttctgtaatcagcgtggatttttccctgattgccgagaccggagaagaaaaaatcccggaaaaatccagaattttttcagataaagaaccaaatattgattacatcaatgcgcttacacaggacgagacctatcagtctttctgtaacagtccgactccgtttttctttccaggatatatcacaggaatttctactctcaccatgaacatttttcaaaatggagttcctacccaccggcttatcctctatgaagcacaaaaacccattaccaggggcgaatattgtctgctctcccatcttgccggttatgttgaatatctgctctatcatcagcatattccgatttccggacaggcaaatgatttgcatcgtattcttcagacaacactttctgatagaagtgcagactatctcgatatcagtcatcagctttcttctcttggctggaacacccggcatgaatatctctgccttgtctatcagaccacctatcttgaccagaaaaatatgactacacgcgccatctgtaattacatggaaaatcattttccggactgctcttcttttttatttaaagatgaaattgtcacattttttaatctttcacttttacatgcaggcagtgatgaaattgcttcaaaactgacttattttatccgagacagtttcttaaaagccggatacagccgtgccatgaccggacacatgaatctaagacgtcagtatgtgcaggcgaaaacagcacttgatgtcggcagtcgaaaaaaaccttatgtatggattcatcattttaacaatatcgctctcccttatattttagagcaatgtacccgccgacttcccgcttctatgatttgctatgaaaatctgttaaaactccaggcacttgaccaggaacaaaactcggaatatgtgctgactttaaaaacctatctcgaacaaaatttaaatgccacgcagactgcaaatgaactttttatccacagaagtacgtttctctaccggcttgagaaaataaaatctattttagattctaatttagacgaccccgacgagattttttacctgaatctctctcttcgtctgctcgaacaggaagcagaaaaaaattaatgatccagatactttttttcttctcttcgataaatcgagagttccacatacagcctggatgcaaaatcatccaggtctaattttgtcagctccttgattcgttctaaccgattcaaaaatgtgctcctgtgaataaacagttcttttgccgtatgagccgcattataacgacatttcacataacattccaatgtcttataatactgtgtccccatctgtctgtcatgctccatcagcttttgcagtgccagggaatctacttcttccgaaagaaattcctccgctccatgcatcatcagatacatcaatgcatactcatcaaaccgataattccactgttccggatttctcttcatccccagttcaaatcctatctccgtctgtctgaccgcagacataaagcgttctgtcttggtaaattcacggctcgatgcggcagtcagcagattctctctcaaaaaataagcaaggtctgactgaaaatccaccattggacttcttgaagtatttaacaaaacatacagacctctatctgcaatcacacagcatgtatctttccatctgcgttccatttccggacaaagataacgttcaaataattccctgtctcgtctgcatttagaacgaagctcaatcaaacagaaatgttccccttttttccatccaacattttcaaatgcaacgtcccacttcttctccggacagctttttccatccagacattgtttcatcacccgatgtaattcatccattgacacatccgattgattaaaagaaccataacgtgcatacattttttctacataatctgcaagcagttccaataaatccttatgataatcgttttgcagtggagaactcgaagaaagtgctgtaagttttcctacataagccccttcaaaaaaaatgttcttacataaataagttccctgttctaaactataactatatacaccttttaatttaatggtgttttcataagaaaaatcacagataaactcactgacaaattttaaatccaatgcattttgagaatttttgaatggtacaaaatatccatctctgtccacggctgcaacataaacaaacttctcatctgtcagtgccaccggtgtttcaaaaatcttttcacagcaactcatcaagtgtgtaaaatcaagattttccataaacacatctataaccgatttttcaaacttttcaaaataaaaaaagatttcctgaagccggttgaaaacttcctctctttccacttctttatccagtatgattaaatctctatctgtcctgcaaaatatagtgtctacctctccaaaacagataaaaacacaatctttaagcgcaggagattttagcgcaattttctcaaatttctcattctccactaatacgatatgtcccgaaagattttctccttcccggtaataaagtggcttttctacaagaattttctttggattacaggaaattctgcgaatcgaaaataacttttttagatgataataaatttcgttaaatgtaagcttcatagtacatttcctccatactacaaagtgtagtgtcacaccctctaaaagtcaattatttcatcggatttacgatttcataaattcctgctatgataaaactatcttaagagaacgaagtcaaaaagtaaaaaaagaataacgaacgtaacaaataaaggaggtttttttatgttaactaaacgtcagaacttattagaaaccatccatggcggaaaaccagaccgctatgtgaatcagtatgaagcatttgctatgttattcaacaacccacacagcatgcatgaccctgctccggaatatggaaaaccaccggttaaaaatgcatggggtatcacaaaagtatggccggaaggcacacctggcgcattcccgattcatgatgaagaacacattgtatgtaaagatattacaaaatggcgtgaaactgttcatgcaccacgtctggattattccgatgccgagtgggaaccttttatcaaagaagcagaaaaaatcgaccgaaatgaatattttgtgacacagtttattgctcccggaatttttgaacaatgtcattatcttcaggaaatccagaatgcattaattaatttttatgaagaaccggaatatactcaggaattaattgattacttaacagaatgggaactcgaatatgcagaaaaaatctgtaaatatattaaaccggatgcactcttccatcacgatgactggggaagccagaattctacttttatttctcctgatatgtttgaagaatttattctgccatcctacaaaaaaatttacggctattataaatctcatggtgttgagctaatcgtacaccactccgattcttatgcggcaactttagttccttacatgattgatatgggaatcgatatctggcagggaaccatgagctccaacaatattccagaattaatccaaaaatacggagacaaaattaccatcatgggtggaattgacagtgcctctgttgaccgtccggattggacaccggaactggttgaaaaagaagtacgtcgtgtctgcgaagaaaacggtacaaaattctttattccttgtatcacacagggtcttggaatcagtaccttccctggtgtatacgagacagcaagcgaagtaattgataaaatcagtaaagaaaaattctaatctcttctctataccaaaaggacgaagcttcaaaagctccgtccttttttcgatacagatcatcaaacgatatcaacttaaatcggcatatttgcaataaataaatacatcacaataaaatggcagatacttccccccatcacaaacagatggaaaatttcatgagagccgaaatttttatgctttgcattaaataacggtactttgagtgcataaatcactccaccaacagtataaatgattccacctgccaacagccagccaaatcctgccggattgagtgcttttacaatcggaataaaagcaaatacacacaaccagcccattgcgatataaatcacagaagaaaaccattttggacaggtaatccagcatgccttcacaatcgttccaactattgctactgaccataccgcaatacaaagaatcgttcctgtttttccatgaagtgcaatcaggcagacaggagtatagcttccggcaattagaaagaaaatcataatgtgatccatttttctaagtctgcggtttactttctcagttgaatccactgtgtgataaattgtactcgctgcatacaacagaatcatactcagaataaaaatgctcatcgcaatcaggtgaatcttatccggttctcttgctgcctttaaaagcagcggggcagccgcaagtactgccatcacacatgcaataaaatgagtaattgcacttccagggtcttttattttaaatttcatacaaaacactcctctctattctgcaaaattatatgattagtattgtttattattttatgtagttttaattactacttgttatgaaatataatactacttattttctctttttgcaagtgatttttgagagaagtaatcgacttattttgacaaaacagaagttttaacaaaaaaagaagtacgaattgaagaatttcttcattccgtacttctttttttattacttcttatttcaggcttataaattatccaaagtatctctttaacagaccagcaaatgcttttccgtggcgagcttcatcttttgccatttcatgaacagtatcatggattgcatctaagtttgctgcttttgcacgttttgccaggtcaaatttaccggctgtagcaccattttctgctgcaacacgcatttccaggtttttctttgtgctgtctgttacaacttcacctaataattcagcgaattttgctgcatgttctgcttcttcgtaagctgctttttcccagtataaaccgatttccggatatccttctctatgagcaactcttgccatagccaggtacataccaacttcagaacattcaccttcaaagtttgctcttaaatctgctaagatatcttcgcttacgccttttgcaacaccaactacgtgttctgctgcccagctcatttcgtcttctttctgttctacaaatttgtcagcgccaacgccacatactggacatttttccggtgctgcttcgccttcataaacatatccacatacactacatacaaattttttcataactgttttctccttttttaatttgataatttatttttagatttttaataacaataattattactgttttaatataacatacttgactttttttgtcaactagtttttttcttttttaattcctgacttttgttttccagacactccttacagattccataaaatgtagttctatgtccgtggatttcaccatcaaagtttttggcaatccgttctgtaagacctgtcagatgctcatcttcaatatcaaaaatattatggcatctggtacagatgaaatgactatgcggttttgcatttccatcaaagcgatccggtccgtctcctgtcggaacttttacaatttcatctaattccactaagagcgaaagatttctatataccgtgccaagactgatattgggatactctttacgaattgacgcatatacatcatcagcagtcggatgctcttttgaggcttttacaaactctcgaatggattccctctgacggctgtatttcaatgtagccatcgcatttcataccccctttaattcttactttaataacagtaattgttactgtgattaaaatatatcatacttaacaattttagtcaagtatgtttttaaaatttttttcaattaatttaagcttgtcctttcttgcaagctgtttgatttcccactctcttttcattgcttcctgcctggtcaaaaatctttcataatagaccagctctaccgggcgtcttgcccttgtatactttgcgccttttccggcattatgattctgaatccgcttctccagattatttgtccaccctgtataaagactgtcatccttacaccttaaaatatacgtatagttggcactctcctgattttccatttcacaaattccttttatgtaatgggcactgacaaaacagcacccttctatttttaagccgccgattttaagaagtatttcactcaaaaaattttcacttttttatagtctaaattgaatcggctgcggattttcttttccgcatactttattatactcctctgtgcttcaaatgtgaatctttacacggtatttcctgttctgtttttatggcagatattccagcgggtcaaccgatactccatcctttgtcattgcaaaatataaattagaaccttctttgctgtagtacttcgtcggttcactcacataacccaatgttgctccggcttccatatagctttccggctcaaatgccgtatcttttaactgcccataaactgcctgatagccattccccaaatcaacagtcatggtaagtccggtttcttcgttatttacaacagaaacaacctttccatttgcaactgcaagcaccggtgttcccacgcctgccccaactgcaattgccggactgtagcggtattcatttaacgtcggaaaataaatcgtatgatccatgttataatccaaaagcacctgtccttctaccggccactgcatcagcgaactttccgtaaaattcacttccggtattgattgcacagcttctgtctgagtttcaacagactcttcttcctttatttgtgtttctatattttgctctgcctcgtctgtattttccgcttcttccggttcttctgtttcttcttccattactctttctccctctacctgtgaagtatttacatcctgtgtttctggatccttcgattctggattctgtgtttctgaattccggttttcttccgtagtttctttttcctctgttttcattgcctcatcaatggaatcgccctcatttaagacaaattctttttcatttggtacatttttacttccggactgataaaccaccgtacaagtacctgcaattactgccatcagcatcagtcctaaagcaagatgggttctgttttttcttctcatattttcacctcaacctatatggagcatccgccccttcttgttttcatctataggattgccaaaatatgagaagttattcatttttttgcatctctacttctattaattccaaacccggaaaaaaatagtttaaaatttcctgatactgcttgttttcctccgccatttttccagccgtccactggctgagtcccagtccatgtccgactcccctgcataaaaaacgaatcatttccttatctgtctgtacaataaaacaggaagaaggaagctttagaagttcacgcatttcttccccttgaaagtcctgattccctgcctgaatctccaacacataccccaaacgatctgtttctttgattttaatctccccggcatctttaatttcaaatcctgcatattctttttttattaatctgcgaaactcttttaactcaaaataacatccattgacataaaatggactcttcttatcctgaatcgtgtctacagaaatcaaataagcaaaattttcacccagaagttcctttccatctctgcttcgttctgttcccactgcataaaatggaatctgttttacctcatgattcaaagccagcacttttcctctcgtttcctctgctgattctaaaaatacatgaaatcgctctaaaaaaaatggaattcttcttttcgcttttaaatattttgctgcctcttctgctttctgcttttcttctcctttttcccactgcagataaaaatttccacgtgcaatcacagtctgcgccttaatgctctccttcggagcctcccagtctatctgcattgccgttaaaactgctatataatcttcaaaatccgtttcatttctgaccggtggacattctttgattcccaatatcaaggcaacaatcaaacaaggaagccctgccataaaaaataaaaggcatactccggattttattttctttttcataaatttataaaacccagacctcttttgtttattcttatgacaaaacttccctgtcctattcatattcttataatttcaaaatttaactaagcctcattatttttttataatcagtaccggaatcggtggattatttttgcggttgtaataagcactcacaatcaccagatattttttttcatcaaggctctttaaatacgctaaaagtgtatccctttcctcaaatccggtctctcctccgctgtaaatacaaagactcatcactccaccttttttaagcagtctcagaccctctataacggcgtttttactgctttcaggcttcgtagcaagagaatggtcacttcccggcaaatatccgaaattaaagcaaataccgtccacagaagcctcatctgcatactttgccatattttcatgactgtccagtatcaatcttgccttctgctccatcccctctgattttaataatgctcttgttgattcaagtgcctgcttctgaatatcaaatgcaagcacctgtccctctttccctgcaagctcgcataaaaacagcgtatcgtgtccatttcccattgttgcatcaatatacgttccgcctgtcactgcctgcattaaaaacaattcatgacaccattcggttatctgaaatgatttcataatgtcttactttcctccaatgcctgtgcaaggtcatcgataatgtcttctacattttcaattccgacagaaagacgaatcaatcccggagaaattcctgctgccttgagctgttcatcatttaactgtctgtgagtatgacttgccgggtgtaaaacacttgtctttgcatctgcaacgtgtgtcacaatagatgccagttttaagctgtccataaatttaacagccgcttctcttcctgcttttaattcaaatgaaatgactccgcaagttccttttggcatgtactttttcgccagttcatgatatttatcatttggaagtcccgcataatttacatgaccgactaactcatgcgcatctaaaaattctgcaactttctgcgcattataacaatgtctctccacacgaagcggaagtgattccagacttgcatttaataaaaagcagttcatcggagacggaattgaacctaaatcacgcattaactgtgcattaatttttgcaatgtaagcagattttccaaaatgctctgtatacacaataccatgataagattcatccggtcttgtcagcccatggaatttttctccataagcgtcccagtcaaactttccactgtcaataattgcaccaccaacctgcattgcatgtccatccatatattttgtcgtagaatgagtgacaatgtctgcgccccattcaaacggtttacaatttaccggagtagcaaatgtattatctacaataagcgggactccatgttcatgcgcaagttttgccattttttcaatatcaagcacaaccaatgcaggattggaaattgtctctgaaaaaacagctttcgtatttggctgaaatgctttttctaattcttctgccggtgcatccgcatctataaaagtacattcgattcccattttctttgctgttacgccaagcagattcaaggttccgccataaattgcagaagcacaaatcacatggtctccggcttcgcagatattaaagaccgcataaaagtttgccgcctgtccggatgaagttaaaactccggccactccgccttccagatctgtaattttctccgctaccatatcatttgtcggattctgaagtctggtataaaaatatccttcatcctttaaatcaaataagcgtcccatttcttcagatgtatcatatttaaatgttgtgctttggtaaatcggcatcattctcggttcgcctttccttggtttccaaccggaatgtaagcattttgtttcgatgtgcagctcttttcccatttctcatatcgcctttcttggtattatatttcttttattgtaccactttcagacatatcctgccactgacatcttatttttctcttaatcttacacagttatcgacaattatcgacgaaacttcttctgtccatagacaatcagacctacaaatacaacgattccaattgcaagaattatcagcttatttccgctgtctaatttattcatggaatctaaaaatccaagcaccatcatatcaatgccgataactgcaattgcaccacctgttgccatcataaattttctttcgttctccggtgacacaccttttgaaaatctctcacgaatcatacttggctttccccagataacaagatataaaccaatcactacaactactgcagctaaaataatcatcatcagacaatctcctctcattttcgctcactccttcccttatagtatatataagactcaaaaagtattttgaccctaacatcataatactgtaaaattaatatcaagtaaagaaaatataagaccaacgaaaggattgcctgattatgaaagaacaaatttataccattcctttaatggatgcttttaatgccggtgatgagtgcccattctgctttatcgaaagaaatctggaacagcatgccatggattttgtacttggcgccggtgcttcttatatggaagatgatatccgtgccgaaaccgataaagcaggattttgccgtgaacattataaaaagatgtttgaatatggaaaccgcttaggatgcggtctgattttaaccactcatttcaaaaagaaaaacgaagaattaaagcaacagataaaaatgttttctcctgcaaaagcttctatgttcagccattttaaaaaggctcagtctaccacggatgctccaaaaacttctatcggtgtctgggcaaaagcacagcaggaaagctgctatatctgtgactattataaaaatacttattcgcgctacctcgatacgttctttgaactctatcgaaaaaatcctgaatttgtcgagcttttcaaaaaaagtaaaggattctgtctcccgcattttgctgatttagtcgaaaatgcagaaacaattttatcagacaaagaaaaatcggatttttatgaaacgttattcccactgatgaccgaaaacatgcagcgtgtcactgacgaccttgaatggttctgtgacaaattcgattataagaataaagatgcagattggaaaacttcaaaagatgcaattccaagaggaatgcaaaaagctgctggcagctatccagcagatccgccatacaaatcggctttatagaattttagatgctctggcaacgtagtttccgagcagttcagaaatgacacgcaaaaaaacaagagccttgaatcttgaggggggatagattcaaggctcttatttttcacgtctactttataaaaaagaaggagagccgatataagggaaatatcggcatatgaaaaagaaaaagatttttgaaaaaagtcttattggctttgttcaagtaataatatacacagaaattgtgatgattttgtgttcaaataatgaaagaaatatgaaaaagtattttatactttttttatgaattggtattaccgatttgttttttgcttcttttagcgcatgagatgcaattttccttgcaaaaacgcaacaaaaaaagattgaaacctcttatcaagatttcaatcttttaagcagtgaagcatcggggattcgaaccccggacaacttgattaaaagtcaagtgctctaccgactgagctaatgctccatatttcaataatttcatcctgactattcgcaggaaaaatgcccagagccggaatcgaaccagcgacacgaggattttcagtcctctgctctaccaactgagctatctgggcctaataaaattaaattgagtagcggggacaggatttgaacctgtgaccttcgggttatgagcccgacgagcttccagactgctccaccccgcgttattaatttaaaagccgatgatcggactcgaaccgataacctgctgattacaaatcagctgctctgccaattgagccacatcggcataaatcaatgaatagaatcgcacctcatcggtactttcaatgggcgatggtggattcgaaccaccgaaggcgttgccagcagatttacagtctgtcccctttggccactcgggaaatcgcccatattaatttttaaaataaatgggacctacagggctcgaacctgtgaccctctgcttgtaaggcagatgctctcccagctgagctaagatcccattattcttttcgtttcctttcggaaacaacgacccagaagagactcgaactctcgacctccgccgtgacagggcggcgctctaaccaactgagccactgggccttatgaagaatatatcttcaaaactacatatacaaaaccgaaaccatgcagacacttgccgctccactgatttctcagtttctggtcaagccctcgaccgattagtagcagtcagctccatacattgctgcacttccacctctgccctatctacctcgtcgtcttcaaggggtcttacttcctaagaatgggatatctcatcttgaggggggcttcacgcttagatgccttcagcgtttatcccttccaggcttggctactctgccatgcagttggcactacaacagatacaccagcggcctgtccatcccggtcctctcgtactaaggacagctcctctcaaatatcctacgcccacgccggatagggaccgaactgtctcacgacgttctgaacccagctcgcgtaccgctttaatgggcgaacagcccaacccttgggacctactacagccccaggatgcgatgagccgacatcgaggtgccaaaccactccgtcgatgtgaactcttgggagtgataagcctgttatccccagggtagcttttatccgttgagcgatggcattcccacttaataccaccggatcactaagccctactttcgtacctgctccacccgtcggtgtcgcagtcaagctcccttctgcctttgcactcttcgaatggtttccgtccattctgagggaacctttgggcgcctccgataccctttcggaggcgaccgccccagtcaaactccccgcctggcattgtcccaccgccgggtcacggcggctggttagaaacccaatactgcaagggtggtatcccaacatcgactccgtagcaactggcgtcactacctcacagtctcccacctatcctgtacatgcaataccgaatcccagtaccaaactggagtaaagctccatggggtctttccgtcctggcgcaggtaaccagcatcttcactggtacttcaatttcaccggatgcattgccgagacagcgctcaaatcattacgcctttcgtgcgggtcggaacttacccgacaaggaatttcgctaccttaggaccgttatagttacggccgccgtttactggggcttaaattcaatgcttcgtttcctgacatctcctcttaaccttccagcaccgggcaggcgtcagcccatatacctcacctttcggtttcgcatagacctgtgtttttgctaaacagttgcttgagcctattctctgcggcccgcttttacacgggcaccccttctcccgaagttacggggtcattttgccgagttccttggcaatgcttcttccgtcggccttaggattctctcctcatccacctgtgtcggtttacggtacgggtacgttacaaacaatagcggcttttcttgacgcatggctcacacacttccctactctagttcggtccgcatcacgcctttggattgccacacggtttttcctatgtgactcctccttcgcttgccctgggattccattcccaggatgtgctttccacacgtgtccccacagttctgttctaacgcagtacaggaatctcaacctgttgtccatcggctacgtctttcgacctcgccttaggtcccgacttacccagggcagatcagctttaccctggaaaccttagatattcggccataaggattctcaccttattctcgctactcattccggcattctctcttcaatacagtccacagctcctttcggtactgcttcttcccgtattcaatgctcctctaccaatgtatcaaatacattcctcagcttcggtgtcgtgttttagccccggacattttcggcgcaggacctctcgaccagtgagctattacgcactctttgaatgtatggctgcttctgagccaacatcctggttgtcttcgaaatcccacatccttttccacttaacacgtactttgggaccttagctggaggtctgggctctttcccttttgactatccaacttatctcgtatagtctgactcccgataatcaattccatggcattcggagtttgatattcttcggtaggctttgacgccccctaggaaattcagtgctctacctccatgtatctctatcgaggctagccctaaagctatttcgaggagaaccagctatctccgggttcgattggaatttctcccctatccacacctcatccccacccttttcaacggatgtgggttcggtcctccactgcctcttacggcagcttcaacctggacatggatagatcacccggtttcgggtctgcacatactgactctggccctattcagacttggtttccctacggctccacgcctttagcgcttaaccttgccagcatgcacaactcgccggaccgttctacaaaaagtacgcggttccgcatgtaaagcggttccacagcttgtaaacacagggtttcaggttctctttcactcccctcccggggtccttttcacctttccttcacagtactatgctctatcggtcactaaggagtatttagccttacggggtggtccccgctctttcccacaaggtttctcgtgtctcgtggtactctggatcctgccttgtcctctttcctttcccatacggggctttcaccctctctggctggctttcccaaaaccattctggtagaatcaaggaatcaattttgcagtccgaaccccagcatgcacgcacactggtttgggctctttcccgttcgctcgccgctacttaggaaatcgagttttctttcttctcctcggggtacttagatgtttcagttcccccggttcccctccatacgttatggattggcgtatggatacatgaggtcttctcatgtgggtttccccattcagatatctccggctcattggatatttgctcctccccgaagcttttcgcagcttatcacgtctttcatcggctcttagtgccaaggcatccaccctgcgctcttttttgcttggccattcagatcttatagcgttaacatctgacggctggtgttgcttggtttgtttctatttcttcgctgtatttctacagcgcctcgtttcgtctctatcttacgttttacgtattttagatgtttcgtatatgcagttttcaaggtacataaagatgcgagcacatttgaaaattttaaatcttctttctcacatctggctgttttatcagccattcaaacacaaaaactttttatgcttgaatcactggtaaaaccagtttatcctcatcagcacttccctgctgttttaggttgacactttcgtgtccgttctattttctaggctttttctttccccagcctttttttaagggattccggcagccacctgctttcccatgccgtctccagcatagtatcatcggccgcttaagtcttaaccatcgtgttcgggatgggaacgggtgtttcccctaagcgcatcgccaccggaaatatgttgttatctgttttttattgataactcaacagtgaaacacttacgactacttcttcttccttagaaaggaggtgatccagccgcaccttccgatacggctaccttgttacgacttcaccccagttatcaatcccgccttcggcagctccctccctaaggttgggtcactgacttcgggcgttactgactcccatggtgtgacgggcggtgtgtacaagacccgggaacgtattcaccgcgacattctgattcgcgattactagcgattccagcttcgtgcagtcgagttgcagactgcagtccgaactgggacgttatttttgggatttgctccccctcgcgggctcgcttccctttgtttacgccattgtagcacgtgtgtagcccaaatcataaggggcatgatgatttgacgtcgtccccgccttcctccaggttatccctggcagtctccacagagtgcccagcttcacctgctggctactgaggataggggttgcgctcgttgcgggacttaacccaacatctcacgacacgagctgacgacaaccatgcaccacctgtcttctctgtcccgaaggaaaggtcccattacgaaccggtcagatcgatgtcaagacttggtaaggttcttcgcgttgcttcgaattaaaccacatgctccaccgcttgtgcgggtccccgtcaattcctttgagtttcattcttgcgaacgtactccccaggtggaatacttattgcgtttgctgcggcaccgaagagctttgctccccaacacctagtattcatcgtttacggcgtggactaccagggtatctaatcctgtttgctccccacgctttcgagcctcaacgtcagttaccgtccagtaagccgccttcgccactggtgttcctcctaatatctacgcatttcaccgctacactaggaattccgcttacctctccggcactcaagaaaaacagtttccaatgcagtcctggggttaagccccagcctttcacatcagacttgctcttccgtctacgctccctttacacccagtaaatccggataacgcttgccccctacgtattaccgcggctgctggcacgtagttagccggggcttcttagtcaggtaccgtcattttcttccctgctgatagaagtttacataccgaaatacttcttccttcacgcggcgtcgctgcatcagggtttcccccattgtgcaatattccccactgctgcctcccgtaggagtctgggccgtgtctcagtcccaatgtggccgttcaccctctcaggccggctactgatcgtcgccttggtgggccgttacccctccaactagctaatcagacgcgggtccatctcataccaccggagtttttcacactgtatcatgcgataccgtgcgcttatgcggtattagcagccgtttccaactgttatccccctgtatgaggcaggttacccacgcgttactcacccgtccgccgctcagtcccttacatcttcccccgaaggttctgtcgtaagcgcttcgctcgacttgcatgtgttaagcacgccgccagcgttcatcctgagccaggatcaaactctctgatatagtgtttgtccaagttcaagataactgcttggctatctatcccttttactgttttggtttattgaaccgttctttttttaataaatgaatgtaaaagaattttcgttttcatgtgtttcactgttcagttatcaaggttcctgtcgttctttttatcagcgacagctcttatattatatcaaagctgtttttgtttgtcaagaacttttttaacttttttcaaagttttttattttgacttgttgtcgttttctgcgacagctataatagaatatcacatctttatcagcttgtcaacagtttttttacttatttttttatttctaaagagaaacaaaaaataagaacggagaaagagggatttgaaccctcgcacggcgcaaaccgtctatacccttagcaggggcacctcttcagccacttgagtatttctccattgcctgaataacaaatcattattcaattttgctcaactacgtgagcaatgactattatatctaataaactattaaatgtcaatcactttttttcatttttttcaattattttttcaatccgtatttttacttcttttgcaatctctacagacttcatatccttgtattcttcataacggattggttcaagaaaatgcacttgtactttaatcttttcaattgagtttacatcaaacggtttataggaatcaattaacgcaaccggaacaataggacactgtgctttcattgcacacttaaagcttccacctttaaattcatttacatgattcggattctttgtacgagttccctctgcaaagatcagataattccttccggattttacttcttttgttacctgtaccataacccgcattgcctgttttacatcttctctgtccagtgcataagctttcatacatgcaaaaacctgttttaaaaatgggatattctgaatttcttttttcatgactacagaaaacggtgtcgggcatgcatgtataattgcaagtacatcaaataagccctggtgatttggaaagaacataaatccgttttcttttggaatattttcctgaccatgaatttctatctcaactcttccacctttaattgcccgctcatcgatatagcgaagcagttcgtatctttcttcttcggtatacttatccgtatgatttgcataataacaaagtttataccacatatacggcactcgtaaaatattatacagtaccattaaaataattctcttcataatatctttcactttctttaactacaccaaactactgtaaaacaaactccccagcaaattgatttcactgaggagcacctgtttttaagtttctgtctgttctaataagtttgtaagttcttcttcataagacggattttttctcgtaaactgcttataatccttttcataagttttatattcatctgtcttcatgaatttctgaaattcttttttggaattttcactcatttcctctgttacatctttcgcctgcacaatcgaatactttttattgttattttgaacatagtaaacagacaggcatggaatctccaaagtagttttactttctgaatcctcttttttcagtgtataaatcgcatacatcaactcatatccattaaaagaacctaatgattcacattttgtaaactttacgctctttgcatcataagcttcaaacaatgtcatataatgtttgatttctgttttcagttcacttgaaactttgtcctttttatccataccaaaacatttctttactgcattttcatctgttttggtataagcctctattaatgactttgttattttttcaggggattttgtatttactttcgttccacatccgcctaatgacaacagtacaatgactgctgtcatagacagaagaatccctcttaattttttcatcataactctcctcgtacttatcgtacttatgcactctattcttttgctgtctcagtttcttcttccgtttcttctgattcctcttctttttctcttacttttgcaatacttgcaactgtaatatcatttttcagattcatcagctttacacctgaagtaattcttccaagaatggagatatctttacattccaaacgaataataatgccttctgttgtaatcagcataatttcgttttcttcattgaccgcttttacaccaactacatttccggttttttctgtaatcttataacattttacacctttaccgccacggttttggcaggtaaattctccaaccgaagtcctcttgcccattcctttttcagagacaatcaacagataatctccctgacagcttaactgcatgccaatcacttcatcttcatcctgaagattaatgcctcgcacacccatagaaactcttccggtctgtcttacatctgactcatggaaacggatgcactgtccgaattttgttacaagaatcacatcttttttgccgtctgtaaatttaacttcaatcagttcgtcatcatctcgaagagaaattgccgcaagtcccgtttttctcacattgctgtaatcctcaatcggtgtctttttgacaacaccttttctggttgccataaacagaaattctccggctttgaattcattaaccggaatcaccgctgtaatcttctcttctgcctgaagggataacagatttacaatcgctgttcctctggctgtacggcttgcttccggaatctcataagctttcagacgatacacacgtcccatattcgtaaagaacatcagataatggtgagtcgttgtcatcaacagttcttccatatagtcgttatgaatggttgccatgcctttgattcccttaccgcctctgttctgactgcggaagttatctacggtcatacgtttgatataacctaatttggtcatggcaatcaccgtattttcttttggaattaaatcttccatggataaatcatattcatcaaaaccgatggatgttcttctgtcatctccgtatttttcagcaattaataaaatttcctgtctgataacacgaagcagaagacttctgtcacctaagattgctttgagttcacggattttattcaccagctcatcgtactcaccctgcaggcgggcacgttccagtccggttaatgcacgcagacgcatgtctacaatcgcctgagcctgaacttctgtcagtccaaatgcagtaatcaatccttctttggcttcctgtgtatttttacttgcacggataatacgaatcacttcatcgatattttccagtgctttcaaaagtccttctaagatgtgggctctttcctgcgctttatttaaatcatatttggttcttcttgtaactacatcttcctgatgctgtaaataatatttcagcatatccagaagattcatcactttcggctcattatttacaagcgcaagcatgtttaccccaaaggtatcctgaagctgggtatgtttgtataactgatttaaaataacattcgcatttgcatctcttctcaactcgatacaaatacgcatcccctctcggtttgagtggtcgttgatagaagtgattccatcaatctttttatctcttaccagttctgccatcttttcaatcagacgcgctttatttaccatgtatggcagttctgtgacaataatctggctcttgccgtttggaagtgtctcaatatctgtgactgcgcgtactctgatttttccacgtccggtacggtaagcttcttcaattcctcttgttccaagaatcatagctcctgttgggaaatccggaccttttacgatggataaaatttcatccatcccggtatctcgatcctcttccacatagttgtcaataattttaacaaccgcagaaatggtttctcttaaattgtgcggtggaatatttgttgccataccaaccgcaataccggaagttccgtttactaaaagattcgggtaacgggacggcagtaccaccggctctttttctgtttcatcaaagttcggtgcaaaatcaactgtattcttgttgatatctgcaagcatttccatggaaattttactcagccttgcttctgtataacgcatagcagctgcgccatcaccatccacagatccaaagtttccatgaccgtctacaagcggatatcttgtagaccagtcctgagccatgtttaccaacgctccataaattgaactgtcaccgtgagggtgatatttacccatcgtatcacctacgatacgagcacattttctatgtggcttatccggtccattattcaattcaatcattgaaaacagaattcttctctgtaccggctttaagccatctcttacatcgggaagcgcacgagatgcaataacactcattgcatactcaatgtacgactcttccatttttttctgcaggtccacctcgtgaactttatcaaaaatattatcttccattcgtctctccttaactctgtttaagtcaatttaacatcatatgctgaccagaatcacgcaccaagtctcacagacgttcgacttgaacaatctattcacgcatcaaacttaaatatcaaggttcttgacatatcttgcattttcctcgataaactcacgtctaggctctactttatcacccataagtgtcttaaatgttaaatccacttctgaagaagtttcttcatccataacaacttttaacaaaatacggcgttctgggtccattgttgtctcccataactgctctgcatccatctctccaagacctttataacgctgtatacgattattgccgtcacgtccgatttcgttaagaatctcatcctgttctttttctgaataagcataatacacttttttattccgttcaatcttaaacaaaggtggctttgcaagatatacatgtccctgtttaatcagctccggcatgaaacgatataaaaatgtcagaagcagggttgcaatatgtgcaccatcgacatcggcatccgtcatgataatgattttattatatctgagcttgctgatatcaaaatcttcgtgaattcctgttccgaaagccgtaatcatcgctttgatttccgcatttgcataaattctgtccagacgcgctttctctacattcagaattttacctcgaagtggaagaatcgcctgagtcgcacggcttcttgcagtctttgcagaaccaccggcagaatcaccctctacgatgtaaatttcgcacttagacgggtctttatccatacagtctgccagctttccaggaagagacattccctcaagtgcagtttttcttctggttaaatctctggcttttcttgctgcatctctggctctctgtgaaagcacagatttttctataatgatttttgcaactgcaggattctgctctaaatagatctcaagctgattggctacgatattatccaccgcacctcttgcttcgctgtttccaagtttctgttttgtctgtccttcaaactgagggtcttcaatcttgacactgatgattgcagttaatccctcacgaatatcttcaccggaaagattcgcatcgctgtcttttaataatttattctttcttgcatactcattaaaggtttttgtcagtgcatttctaaaaccaactacatgcgttccgccttccggagttgtaatattatttacaaatccataagtgttttctgtgtaggaatcattatgctgcattgcaacttctaccataactccgtcttttgttccctcaaaatataaaatctcttcgtaaagagctgtagtacttttatttaaatactgcacaaattcccggattccgccttcatagtgaaaaactgtttcttttggttcttccccacgattatcttttgcaataattttaagaccttttgtcaaaaatgcaatttcacggaatctgtgtttcaatgtatgaaaatcaaatacggtctcctcaaaaatttcaggatccggatggaacgtaaccattgttccggtcttttccgagtcacaatccccaatgacttttagtttataaatagtttttccacgttcataacgctgacggtaaattttaccctcatgataaatcgtaacctcaagccaggtcgacagtgcatttacaacagatgcacctacaccatgcagaccgccggatactttatatccgccaccgccgaattttcctccggcatgaagaattgtaaatacaacctctaccgcagggattcccgctttatgattaattcctaccggaatacctcgtccattatcaataaccgtaatcgaattatctttgttaattgtaacttctactgtatcacaataaccggccagcgcctcgtctaccgcattatccacaatctcatacacaaggtgatgcagacctctggatgaagtactgccaatatacatacccggtctctttcttactgcttccagaccctccagtatctgaatctggtcggctccatactctgttttaatttctgtgttcatccaattcctcctgtttccctgatatcagttaacgatggttccgtctactactttgaaaagtttatttatctcaaacctgctgttcacaaattcatccagacccgtacaggtaatcatggtctgaatatttttgatgctctccagaagataattctgcctgttcacatcaagttctgataatacatcatccagcagcaaaatgggaacatctttaatttttctttctaccagatgaatttctgataatttcaatgacaaggctgctgtacgctgttgtccctgagaaccgtattttctaatgtcgatatgatttattttaacacacatatcgtctctgtggggacccgatgatgtgtttttaaatttaaaatctttttctctgtttttaagcagtatttccagaaactgttcttcttccacattgggctcataaatcagctcaatctgttctttttctcctgtaatactgctatgtatccgctgtatcacttcattcatctcacgaacaaattcacgtctgcttcgaattaccgaggctccatagcgaacaagctgttcgtcccagatatccagcgtactcttaagactttctttttgtgcaatatcttttaacaatttattgcgctgatttaaaatgtgattgtactgaaacaaatccgacaaatagattttattaagctgacataattctgaatcaagaaatctccggcgctcacctggaccattttttataatatttaaatcttccggtgagaaaaatacaatattcacaatccccagaagttcttttgctttacggattggaatcccgtcaattgcaattcctttcgctttattttttttcaaatgcatatctattctgtgggaaatgccccctttgtttattctgagcttgatatgcgattcattttcatgaaaccgaatcatctcacggtctttacttcctctatgtgactttgttgttccacaaagatacacagcttcaaggatatttgtttttccctgtgcattgtcgccgtaaaaaatattggttcccttgtcaaaccgcaaagataaaaactcataatttctaaaatcctttaattccattgattcaatatacatctgtacacctgtcgctatttcacaattttaatttcctgtccatcataagctacaacatcaccgtcatacagtttcctgcctcttcttgtatctacttctccatttacggttacaagaccatcctgaataacgtattttgcctccactccgtcttctactagattagctgcttttagtgcctgacctaattttataaattcatctcttaattttataatttccatgttttgtcctttctgcgttaatacacttccggagtctttctgtgcttccgattatcttccgacagaattaaagtttaccggaagaatgagatatacatattgtcctgcatcatcacgaataaagcaaggtgcttttggattcatgagataaatatggatttcttcatcatcaatgacctttagtgcatcaattaaaaattttggattaaaaccaatcataatatcttttcccattttgttaatgtcgatgtcttctttcatcgaaccaatctgagagtcgatctggagttccataccctcatcgttaattgtaataataattggttttttatctccttcttttacaagaagagttgcacggtcaatactatctaaaaattcttttttgttcagtgttacctttgtttcgtaatcactggacaacatctggtcaatcttgaaatattctccctcaattaatctcgaaacaacttttgtattgtcaaattcaaacagaatatgattttcagcaaaatagatatccaccatgtcttctgtctcaccggataaaatcttactgatttcatttaaagtttttcccggaacaaccactttcttgtcagaacattcattctttaacggaatctttcggattgaaatacgatgtccatcaagggatacgactctcaatgtgttgttggcaatctgaaataattcacctgtcatcagtttattgttttcatttactgcgatagaaaagatggtttgacgaattaattcttttaatgtgaactgtgaaatctgaacaccttcatttttttcgataaatggcagataagagaaatcttcacctgactgtcccggaatattaaatttcgctttttcacaagtaatggttgtgttttgtttttcgtctgtcacaattgtaacatcattatcaggtaattttctaacaatttctgaaaagattttcgcatcaagagcaacgattcctttttcttcgatagaaccctctacaattgtctcaattccaagttccatatcatttgatgtaaatttgataatattggcagatgcatcaatcaggatacactgtaagattggcattgtcgtttttgaaggaactgccttcatgacaatgtttacactttttagtaactcagactttgaacagattaatttcataatgtggataacttcctttctgtgaaaatggttttgctataaacatatatatatataatatattaatagtagtagtagtaggggatgtggataatgtggataactcttgaaacccttgtaaataaagggcttaatgggtgttgacaatgtggataactatgtggataacttgtggataactcaaaatcaatgtggataacttttctgcttaaacaacttaaaaagtacttaaaaaaaagttatccacatttttcaccgagttatccacatagttatccacaaaaaaatggcagttatccacattttttttcgagttatccacatttttgacacccaaaatgtggataactatgtcaattttcaagagaagtgtggatgaagattaattttttaattttatttaagcgaatttttagctggattaatcttctttttaagtatattaatcacttctctggtttcttcagaatactgaacttctttttcgattcgtttgattccgttcataatggtactatggtcacgtcccccaagcttgtcaccgatgattttcaaggtgatatcagtcatttgacggcagaggtacatggcaatttggcgcggataagtgatttgagagcttctcttgtttcctattaaatcactggcggataaatcaaagtgttcagcaaccgtacggataatgatttcaggggttacgaccctcatctcttcatccggagaaatgatgtcttttaagactttttcagccagagcgaggttaatttcacagttttccagattggcaaatgccatgatcttattgagagatccctctaattcacggatgtttgaggtaacgttctttgcgatgtactcaatgacatcatcatcaatataatagccgtcaagttcttcttttttcttaagaatcgccattcttgtctcgtagtcaggagctgaaatatcaacgattaagccccattcaaagcgggaacgaaggcggtcttctaagatttccatatctttcggaggtttatcagaagatatgataatctgtttttttgcaccgtgaagtgcattaaaggtgtggaaaaactcttcctgtgtagattcttttcctacaataaattgaatatcgtcaatcatcagaacatcgatgttgcgatatttctcccgaaacttagtcatggtcatatctgcattattaccactgcggatagattcaatcaattcatttgtaaaaatttcacttgtaacgtacaatacccgcgtttctgggtttttctgcagaataaaatgtgcaattgaatgcattagatgtgtttttccaagaccaacgccaccgtagataaacagtggattataagcttctcctggggattcagcaaccgcaacggacgctgcatgtgccattttattgttgcttccgactacgaaagtatcaaatgtatagcggggatttaagtttgcacgctcaacattttcattaataatagttgagggagcttgtactgtttcagatggaatatcttttggctcgattagggcaatttcatattcttctccggttgcctcagaaatggctacttttaagggaagaagataacggttagtaatatagttgataccaatcagcccggtagggactacaattgtcacttcattgtcctcaacactgtggacagtaagcgtttcaagccatgttttgaaagaaatatcagagagctgatgttcctctctgatggtattaagaatatccgtccatttttcttgtattggatgcatggtgtatctcctgtgtttaagtaaatataaaacaacgtaacaatagaaagtgcgaaaaatacactttctatcaaaatactacaagttttgtatttatctattctataataaattgggacttttatcaaccgtttaatcacaaaaatgtggaaaactatgcgaaaaatgtggaaaacttttcccaatgtggataatgtggataacttgcaaaaaagcaatgtggataatgtggataactcgaaaaaaggcattatttgcaaccagtaaatgtggataatgtggataacttctttccacattatccacacgctaaaacccttgattttaaaggattttttaaaaaccaaaaaaagttatccacattttttttgaagttatccacaaaaaaaggtcgagttatccacattttttttgaaatattatgtaaaccaaaaaatgtggataactttgtggataacttttttaaagagtggaaaaattgaaaagttatccacaaaatgtggataacttgcaaaagtgaaaatgtggataactttttcgcaatgcggataaatgtggaaaacttaaaaagcgcaaaataatccataaatgacaaattttaaaagcttcagtcaggcataaattggtataaaaaaatcgaaaaaatgcttgacggagagggggtttatgaatataattgaaatgatgtttactaaataatgcataaccataggaatactatctcaagatagatagatatttatttaaaggaggtgcctggaattatgaaaatgacatttcagccaaaaaagagacagagatctaaagttcacggattcagagctagaatgagcacaaaaggtggaagaaaagttttagctgcaagaagattaaaaggaagaaaaaaattatcagcttaagaccgcagacatgtggtcttttcttctcttttcattaaaaggatggtttatgaaatattcggagtcgttaaagaagaacagagattttcaactggtttataaaagtggaacatcaaaagcaaatcgatatctggttatgtatgtaagagaaaatcagttagaaaaaaacagagttggcatatccgtaagcaaaaaggtgggaaacagtgttgtgagacaccatcttgcgcgccttataagagaaagttaccggttaaatgaggaaaagtttaaatgcggatatgatattgtaattgtagtcagggtaaatggaaagaaccaggggttccattccatagaaagtgcattaatgcatttaggaaaactcacaaaaaccataaaaagcgaagagaatgaaaacgatactaattaaattgattcggttttatcaaaagtatatatccccattaaagagtacacgttgtccctatattcctacgtgttctcaatatggactggaagcaattgaaaaatatggagcagtaaaaggctgcttactggccggttggcgaattttaagatgtaatccattttccaaaggcggatatgacccggtgccctgatgaaccgaaaaatgatgtggataagaacacacactaattagagaaatattggggtcaccggttatataaggaggacgaattttgggtgcattgttaagtaagagttcaatgccgattgtaaaatgggtagccgaggtaatgggctggctgatgaacggcatttacaagattgggattcataatctcggtctttgtattatattatttacaattatcatttatgcattcatgatacctctgcagattaaacagcagaagttttcaaaaatgaatgcagttatgtcaccagaattgcagaaaatcagtaaaaaatacagaggaaaaaaagaccaggcttctcagatgaagatgcaggaagagacaatggcagtttatgaaaaatatggtgtgtctccaacaggaagttgtctgcagttattcattcagatgccgattttctttgctttataccaggttattattaatattcctggatatattggcgagattaaagcaatttttgacaaagccgttgtaagtatcacaagtgtagacggatacgcagatgtcctgacacagtttatcaaggatgagggattaagaacttatacttggagagcagatgatgtaacaacaaaccgtattattgatgtattatataacttatcaccaacacagtggaaacacttaggtgaaatcagtgattttagtggattctcagatgtattaagcaatacagcaaatacaattcgtccgatgcagaatttccttggactgaatatcgcagataccccgcttgcactgattaagtcaggatggagttcacactcttatctgttgattcttgcagcagttttaattccggtattatcctggctgacacagatgttaaacattaaattaatgccaacggcggcaaccactcaggacggtggagcaaatgaccagatgaacgcaacaatgaagagtatgaacacatttatgcctctgttttctgcatttatctgtttctcattcccggttggtattggtatttactggattgccggttctgtgattcgttgtatccagcagcttattattaataaacacctggacaacatggatttagaagactatatccgtaaaaatcaggcaaaagctgctaaaaaacgtgaaaaatcaggacttccgccacagaaaatcacacagcaggcaaaacagaatgtcagaaatattgaagaaccaaaatgtaccacaaatttaaagaaatacaataataacagtggttcaaaagctgtagatacttacagagaagtaccggaaacaaaaccgggaagccttgcatcaaaggctaacatggttgcagaatttgataaaaagaataagacaaagaaaaaataacggtaagggggaagcgttatggaattcaaagagttttctgctaaaacagcagatgaggcaattatcaaagccagcattgaacttggcgtttccagtgaaaatctggagattcaggttgtgactgaaggcagttcaggattttttggaatcggtaaaaaaccggcaatcataaaagctcgcagaaaagaagaaaccttaccggaagaacctgtagcagaagaaataaaagagtctgttccggtaaaaaaagaagtgaaaaaaactgataaggcagcagaaaaacctgtagaagaaaccgtaaaaccggtgagacatcaggaaacaaaaaaagagcagccaaagcctcgtgaagagaagaaaatcatcaaacgaagcgaggaagagattgcagaaatcaaagcggaagctgagatgttcttaagtggtgtatttaaagcaatggagcttgaagttgagcttaaaatagaatacacagcagaagacggcagccttgaagttgaatttatcggacaggatatgggtattctgattggaaaaagaggacagacactggattctcttcagtaccttacaagccttgttgtaaacaaaggcagacagggttatgtccgtgtaaaacttgatacagaagactatagaaacagaagaaaagaaacacttgaaaatcttgcaaagagcattgcttacaaagtaagaaagacgagaaaacctgtttctttagagccgatgaatccttatgaaagaagaattattcattctgcacttcaggggaaccgttatgttgaaacatatagcgagggcagtgaaccatatcgccatgtggttgtaaaattaaagaaataatgtaataaaaaataaagacgttctaggtgaaagcgtgaatgttggagatggattctctgtgcttttatctggagcgttttttgtttcttaagagtaaattaaaaagtatattaaattgggttaggaggctggattatgccgatactggcatcagaaacgatagcagcagttgcaacagctatgaccgcttcaggaattggaattatacgaatgagtggtccaaaaagccgtgaaattgcaggaaaaatctaccgttccaaaaatggaaaaaataagatagaagaagtaaaatctcacacgataaattatggttttatttatgatggagacgaagaaattgacgaagttttagtcatggtaatggacggtccgagaagttatacaggggaagataccattgaaattgactgtcatggcggtgtgcttgcaatgaaaaaagtgctggaaacagtcattaagtatggtgcaagaccggcagagccaggcgaatttaccaagcgtgctttcttaaacggaagaattgatttatcacaggcagaggcagtcattgatataattaatgcaaagaatgagtatgcattaaagagttctcttcatcagttaaaaggctctgtgcagaaagtaatctgtgaaatcagagagaatattatctatcatattgcatatatcgaatctgctttagatgacccggaacatatcagtgtggatggttatggggaaactttggggaaagatatcaaaattcagaaagagaaagtggaaaaccttctttctacagtaaaagaaggaaagatgatgaaagagggcattaaaacagttatcgtagggaaaccaaatgccggaaaatcgtctcttatgaatgtacttgtaggagaagaacgtgcgattgtaacggatattgcaggtacgacaagagatattttagaagaaacgattgtgcttcatggaatttctcttcgtatgattgatactgccggaatccgtgatacagaagataaagtagaacaaatcggtgtaggacgggcaaaagagtatgcaaaagatgcggatttgattctttatgtggtggattcttcacgtcctcttgatgaaaatgatgaagaaatcatggagattctcgaagataaaaaggcaattgtgctgttgaataagaccgatttggaacagaaagtaaccgaagaaatgttaaaagaaaagctttctcatccagttgtgtcgatttcagcaaaggaagaacagggaattgatgtgctggaacaggagattaaaaacatgttttttgaaggtgaattaagctttaatgatgaagtttatatcacaaatatgagacataaaacggctcttgaagaagcacttgacagtttaaaaatggttgaaaacagcattgaaatgcagatgccggaagacttcttttcgattgatttaatgaacgcttatgagtctttaggaagtattatcggagaggctgtaggggaagatttggtcaatgaaatcttctcaaaattctgtaccggaaagtaaaaaatcaggataaatatagaagcgaaaaaggagaaaaacagatgaatcatttgacagaaaattatgatattgctgttgttggtgcaggtcatgccggatgtgaagcagcacttgcgtgtgcacgtctggggttggaaacgattatgtttacggtaagtgtggacagtattgcactcatgccctgtaacccaaatgtcggtggtagttccaagggacatctggtacgtgaattggatgctctgggtggagaaatgggaaaaaatattgataaaacattcatccagtctaagatgttaaatgtatcaaaaggtcctgctgttcattctttgcgtgcgcaggcagataaacaggaatacagcagaagtatgcgccatacactggaaaatacagaacatctgactattcgtcaggcagaggtaacagagattcttgctgaggacaaacagattaaaggagtaagaacctattctggtgcagagtatgcagtaaaagcggttgtgctttgtacaggaacttacttaaaggcaagatgtatttacggtgatgtaagcaatcataccggtccaaacggacttcaggcagcgaatcatctgaccgattccctgaaaaaacttggcatcgagatgtatcgttttaagacaggaacacctgccagaattgacaaaagaagtattgacttttcaaagatggaagaacagtttggagatgaaagagttgtaccgttttctttctctaccaatcctgaagatgttcagattgaccaggcatcctgctggctgacttataccaatgaaaccacacatgagattatcagaaataatttggaccgctctccattatattccggtatgatagaaggaacaggtcccagatactgtccatccattgaggataaagttgtacgttttgcggacaaaaaacgccatcaggtttttattgagccggaaggattatatacaaatgagatgtatgtaggcggaatgtcaagctctcttccggaggatgtacagtacgaaatgtaccattctgttgcaggattagagcacgcaaaaattgtaagaaatgcctatgcgattgagtatgactgtattaatgcaagacagttatatccgacacttgaatttaaagaaatcaaaggtttgttctcaggcggacagtttaacggaagttcaggatatgaagaagcagctgctcagggattgattgcaggtatcaatgcagcaatgaaagtgcttggaaaagagatgctgattttagatcgttccgagtcttatattggtgtattaatcgacgatttggttacaaaagagaatcatgaaccataccgaatgatgacaagccgtgcggaatacagactgcttttaagacaggataatgcagacttaagattaagaaaaaaaggttatcaggtgggtcttgtaagcaaagaacagtatgattatgttttgtggaaagaagcaaaaatcgaggaagaaaaagagcgtgtggaacatacttatgtaggagcaacgaaagaggtacaggaactgcttgaacagtacgaaagcacacctcttaaaaatggatgttcccttgcagaattaatccgccgtccggaattaaactatgaattattagctcctttagataagaaaagaccggaacttccggaagatgtaagagaacaggttaacattaatatcaaatacgatggatacattaagcgccagatgaaacaggtggaacagtttaagaagctggaaacaaagaaacttccggaggaactggactatgaagcaatcagcggacttagaattgaagcaagacagaaattagaagaataccgtccggtttctgtaggtcaggcttccagaattgcaggggtttctccggcagatatttctgtccttcttgtgtacctggaatcttatcgaagagggggaaatgggaatacatgaattatgatttaacgctgttagaaaacgctgtaaaagagtttaaaattacactttcagaagaacaaaaagcgcagtttattcagtattatgagctgttaattgagtggaataaggtgatgaatctgaccggaattacagagtttgatgaggtacttcagaagcattttgcagacagtctttcggttgtaagagcactggatatgagcaaaattgagagctgtattgatgtcggaacaggggcaggatttcctggaattccattaaaaattgcgtttcctcatctgaaagtaactctgctggattccttaaataaacgtttgaaattcttaaatgaagtcatcgaaaaattaggtttagaaggcattgaaacagtacatggacgtgcggaagatggtgcaaaaaaaccagagcttcgagaggcttttgatttaagtgtgacacgtgcagttgcaagggtaagtgtaatcagcgagtattgtctgccttatgtaaagacaggtggatactttgctgcatataagtcgggaaaagcggcagaagaactggaagaaggcaaaaaagcgattgcagttttaggcggaaaagtcgaaaaaacagaagaatttttgttgccggactcagatatggaacgtacgattttgctgataaaaaaagtaaaaaatacaccgaaaaagtatccgagaaaagcaggaactcctgcaaaagaaccgattgtataagtggaaaattggataaaaaattgtatgaaaataaagaacgaaagagagctgaaaaaggctctcttttttttattagggatatttgcaaggattcacagaaaaaacacattctcatctaatttttatcacaaatagtaaatagaatagaacggtgagaaaaatataaaaaagcaagtacaatattaaaggagggaataccttgattgaagtaaaggatctggtcaaaaaatatggtgaccatgtggccgtagaccatttgagttttaccatagaaaaaggaaaaatttatggatttttaggaccaaatggagcaggtaaatcgactacaatgaatatgattaccggctacattgcctcgacacagggagaaattctgattgatggacacaacattttagaagagccggaagccgcaaaaaaatgtatcggttatttgccggagctacctccggtttatcaggacatgacagtcagagagtatttaaaatttgtagctgagttaaaatccattccaaaagcagagcgggaaaagaatataaaagaagttatgtcaactacaaagcttgaggaagtacaggaacgtctgattaagaacctttcaaaaggttttaaacagagggttggaattgcacaggctctgcttggatatccggaaattattattttagatgagccgaccgttggtcttgacccgaaacagattattgaaatcagggatttaattaagagccttggagaaaaacataccgttattttaagttcacacatcctttcggaggtaagtgcggtctgtgaccatgtattgattattgaccgtggaaaactggtggcaagcgacacaccggagaatttaagtaaagtaatggaaggcgcaaattctcttgaacttacagtaaaagggaaagaagaagaaatcagagaggcaatgaacctcgtagaaaatattcaggaaatgatttaccatgaatcttttgtgccggatgcctgtgattttaccgttaaaatatcaggggaacaggatatgagagaaaacattttctttgctctggcagatgcaaaatgtccgattttaaaaatgcagccgacaaatatgacgctggaagaagtattcttgaaattgaccgaagacgacaatgaggaggagaaagaaaatgctggcgatttataaaaaagaattaaaaagttatcttacatccatgcaaggatatgtgtttatggcatttatcatgctggttctggggatttattttacggcatataacttaaattatgcaagtccggactttggaacaaccttaaattccgtgacgtttgtatttttgattatcactccgattttaacaatgagaattttagcggaagaaaaaagaaataaaacagaccagttattattcacttcaccggtgccaatctggaagatagtatttggaaaatatcttggaatggtgacaatttatctgattccagttgtgattacgttgttttatccgcttattttggcaaaatacggaacagtttcttatcctatgaccttaactgcaattgttggatttttctttttgggatgtgccaatattgcagttggactttttttatcttcgattacggaaagtcaggttatcgcagcggttcttacctttgtggtattattctgcagttttgtcatgaatggaattgaatctttcttttcacagacggcgatggcttccatgcttgcatttgcggtacttgcagtcttaattgcaatggtcgtctatcagatgacaaaagataatattttgaccggaattacaggagtggtactgcttggagcagttgtaattatatatattgtaaaatcctctttgtacgagggagcaattcaaaaattgttagatttgctcgcaatcgcaaatcattttgataattttgtaggaggaattttggatttctccggaattgtatatatgttatccgtaatctgcattttcatatttttaaccgttcagtcaatacagaaacggcgttggagctgatgatttgaggtgaatagagaggagaaaatgcaaatatgaagacaaacaatgaaaataaagagttaaacaaagactcaaataaagatttaaataaagacttaaataaagggtcaaatgaagatttaaataaagagtcaaataaagacgtaactaaaaaaacgaataaagagtcaaacggcaaaaaattcaaaaaaatagatttcaaagaattacgaaagaaaagcaaggaaaaacgaatccaaaataaaaagaacttaaagcatggttcctacagcatgggtgcaattacaatttttattgcgattatcgtagtattaaatctggtattgcaggaagtgccgtcaaaatacagagaaatcgatttaagtacgcagaaactttacagcattggtgaccagacaaagaaagtacttaaaaagctcgataaagacgtagagatttattatattgcgcagagtggttcagaaagcagtgatatccagaaacttctggaaaaatacgaagagggcagtgaccacatcaaagtggaacagaaagaccctgcagtaaatccgaaatttgtttcacagtatacatcggatggcgtgagcaataacagcgtaattgttgtgtgcggagataaaaataaagtcattgataacaactcattatatgaaacgactgttaattatcagacttacagtaacgaggtaaccggatttgatggagaaggccagattacaagtgcaattaattatgtaacatccgatagtatgccggtgatgtatacgttagagggacacgatgaagcaaccatgagtgataccttaaaagataccattcagaaagcaaatatcgatattcagtctttaaatctgctgacaatggacagtgttccggacgatgcagacatcttgtttatctttgcaccggcaaaagatatttcagaagatgaggcgtctaagattatttcttatctggaaaatggcggaaaagcgttgatagtttctaattattcttctgaagaaatgccaaattttgcttctgtattagagaattatggtgtgaagacggcaggtggaattgtacttgagggagataccaatcattatatttctcagaatccatcctatctgcttccaaatatcgaaagtaatgacattacttcaagcctgtcatctggcagtcgatatattttaatgcctctggcacagggaattgtaaagagtgataactacagagattctcttgaaatcactgatattctgacgacttcagacggttcttactcaaaagtaaatgtagaagatatgcagacaatggaaaaagaaagcgatgacattgacggaccatttgcagttggtgtttccatcacagagaatttagatgatgagaaagaaacacagattgtttattattcatccgaagcgctgtttaatgaccagatgaacacaatggtatccggagcaaactatgaattgatttctgcttctgtaaactggatgtgtgagagcgaagaggatagtaatacaatttctattgcaagtaagagctatgatacttcaacacttacaattccggcagcagatgcaagtttctggagtatctttgtaacagcagttgtaccggtagtgattctggtaattggcggtggtatctggatgaagaggagaaaacagtaatgaagaaaaaaaatatcggattaatcgcaggaattgtactgcttgttgtgctctgcgtagtctattttgttcttcataatcataatgccagcagcagtgaagcagatagtacagatacagcagcaacagcgtttgagacagatacagacaaattgacagagctgactgtgacaacggaaggtcagtcttatacttttacaaaatcagatgataaatggagttatagtgcagatgcttcatttccactagaccagagtaattttgaagagctggcaggaaagttaaaatcaatcagttcagacagggagctcaaagatgtagaggctgtatcagagtatggacttgatgtacctgctgtacaggtttctattaaaaattcggatgatgaaacccatacattagagtttggtgcagtaaatgacatgacaagcaattgttatatgacaattgacaaggataccagtaaaatctatatggttgcttctgatcttgaaaccgcttttaattttaatttaagtgaccttgcagaaaaggaaagtttcccgtctattacagctactacagttacgaaactgactgtagaaaaacagggcgaagaagccgaagtgattgaaaagagtgattctgcttccaccggatggagttatacaaaaggaagcacacaaagagatattgacagttctaatacttccaatctcttaaatggaatttccagtctttcctggggcagttttgtaagtgcagataccagtaagcttgcagagtatggattggatgcaccgaccaagattatgattgattatcaggtgacagagacaaaagacagtgacacgagtaccagtgaagatgatacgagtgaagacagcagcagtaatgaagatgcagaaaatgactctgacagcgacagtaccacagaaactgtgacaacgaataagcaggaagttttgcttcttggaggtcaggacagcagtgggaattattatgcgaagcttgaaagccagtccaacatttataccatttcatcttcgagtgtggaaagtttcttaaatatcgacgtgaaaactctggtcagcaattatgtctctaattatatctttgcagacctcgaccgtgtaacaattcaaaaagatggagaatcttatgaatttacaaaaacaacggaagagaaagcaaaagaaaaagatgacagtgatgattcaaagtctgaagatagtgatacagaatcggatacagaaactgtgacaacctattttatgaatggaaacgaaataaaattggaagatttctcaagcttctatagtaatatcagttctctggaatgtcaggagtggcttgatgaagtaccggaaacacaggatgagccggaaatgactgtagaattttataaagaaaatggagtttacttcaaagtagaatattatccgtatgattctaacttctatcttgtaaaaaataatcagggaactgcgtgtctggtcaataaaatgaagataaaagaaattgaaagttcttttgaaaaatttttggaaaaacagaattaatgagtagaaattaaaaagcgagaggaatgtttcacgtgaaacattcctctcgctttttagtcatcaagaaaaacagacagacaatcaaataactgttctggtgattctaactgaggaagatgttttgcttcttttaaaatgtaagtctcaattgccggatttaattctacatattgagagagaacttcgcacttagtgagttcgccttccccttcgataataaagatgctgttgtttatattttttaatgcatgtacgatattgttgttagtatatcctccaagtaaactggagaataagaaacgaccgcttcccatgcctttgtgggctgcttcatagtaagtgtcgagccattccgctttgatatggaatggattgtaaagataatcttctgtaaatgcaagttgaacattactctggcagaccatcatgttataaacaagagttccgaacacaggaagctcaagaaaagatttataaagcttgctgcgtttggttggaatcttatttaactgtgaaagtgccggcggattaatcattaaaatttttctaaacagttcgttttcgttatgacaggcgaggattgtaaaagagccggaaaaaccactggtaatcacatcggttctttcgtgaattacgtttttgataaaatcagatattgcctggacatataaatagttggtgtaagtaatatgctgtttatcagaacggccgcatccaggtaagtcgatgcagtagacggtatgatttttctcaagctgttttacaagtgcttcccattcataagcggaactgtaaatggttaaatcgtgaattaataaaacgggagaacccgtaccttgttttgtgtaataaatttttccaaaacgccaattgtaataattgcttgccgttgactttaacaagtctttcattattgcggttgtagaaatcagatggttcatgaaatgaataatagcagttgcggtggtaaataatataccggttgtaataagtttgtatctatgctttttcataaaaaaacctcccaatataggattactttagttagttataattataagccattaactcttattatacaagctgaaagtagggagaagaatagtgtgataataaaaaaaatgggaaatgtttcacgtgaaacatttcccatttttttattgattgattaatgaaatttatatcgtaaaaaaatataatgtttcacgtgaaacatttgtgtagaaatacgtttaagaagatgttataataaccattgaatgaaataaatacgaagtttgatgaaaagaggaaacttaagtgggaagaataatagcaatagcaaatcagaaaggcggagtaggaaaatctacaactgcaatcaatctgtctgcatgtcttgccgagctgggacagagagtccttcttattgatattgacccacaggggaacacaacaagcggagtcggcgtagacaaagataatgttaatgcgactttgtatgaacttctggtgggagagtgcgaaatttcggactgtctgattgagaatgtattcgaaaatttatccttgattccgtcgaatgtgaatttgtctggtgcagagattgaactggtaggcgtagaggggcgtgaatttcttttgaaaaatcatattgattccattcgtgataattatgattttattattatggactgcccgccgtctttaaatgtgttgactatcaatgcaatgacaacagcagattctgtactggttccgattcagtgtgagtattatgcactcgaaggattgacacagcttattcacacgattgaactggttcagaaccgtttaaatccggatttggatattgaaggcgttgtatttacgatgtatgatgcaagaacaaatctgtcattgcaggttgttgaaaatgtaaagaacaatctggaccagtctatttacaagaccattattccgagaaatgttcgtcttgcggaagcaccgagttatgggctgccaattaccttatatgataaaagatcagtaggggcggaaagctacagactccttgcagaggaagtattacacagggaggatgaagaatggcggtaaaaagaggtggacttggcaaaggtcttgattctatgattccggttttagattctacagcgacaaaaaagaaaaccggaagaacagcaatcgataaagaagcgctgcagaatgcggcaaaagaagctcataaacatcaaaaagaaaagatggaatttgaggggaaacctggagaacaggtacagattgtgaagctgacaaaggttgagccgagcagggaacagccgagaaaacagtttgatgccgatgcacttcaggaactggcagaatctattaagcagtttggtgtacttcagccattattggtccagaagaaggaagactattatgagattattgccggggagcgcagatggagagcttctaaactggcaggactcaaggaggttcctgtaattgtaaaagaatttacagaacaggaagccgttgaaatttctctgattgaaaatattcagcgggaagatttaaatccgattgaagaagcaatggcatataaacgtttgatggaagagtttcatttaaaacaggatgcgattgcagaacgggtttcaaagagcagaactgcagttacaaactcaatgcgtcttttaaaattagatgacagagttcagcagatgctgattgatgaaatgatttcaaccggacatgcaagagctttgcttgcactggaaagtaaggatgcacaggcggaagcggcagttaaagtattcgatgaaaaattgagcgtacgagaaacagagcgtttagtgaaagaactgttaaatccagtgcagaaaaaagaagagaaacccaaaaatcaggcagaagaactggtttataagaatctggaagagaaaattaaacagattatcggttcaaaggttgcaattaaccgaaggacagataataagggaaagattgaaattgaatactattctcaagaagaattggaacgtattgttgaattattggaaacaataggataagagagaaaacgaggagttagagcagatgggtaatctaatcagcaagattcagtctatttccggtgtgctgtcaatttttttactgattgtggtaattgcacttttggtatgtgtggtcagtctttttttggaagtaaaccgactgaatcaaaaataccgcgtatttatgaaaggaagagatggacagtctcttgaaaaatcgttccgacgcaaatttgcaatgattgacaaagggctggatgcggcagcggcaaatgagcaggaaattgaaaaattaaaagaaatcatgggaaacaccttgaacaaatatgctattgtgaagtatgatgcatttgaggatatgggaggaaaactcagctttgttctggctatgttggacgataagaatacaggatttcttctgaatgcgattcacagcagagaaaactgtttcctctatattaaagagattgtaaatggggaatcctatgtaatattaagccaggaagaagtgcaggcattaaaacaggccgtaaatttcagacaaaactaaaaaaaagaagcagggagaaagattatgttagacattaaatttttaagagaaaatccagatgtagtaaaacagaatattaaaaataaatttcaggacagcaaattacctctggtagacgaagtaatcgaattggataagagaaaccgtgaaatcaaaggagaagtagaagcgttaagagcagaaaaaaataaaatctccaaaatgattggtactcttatgaaagagggcaaaagagaagaagcagaagaagtaaagaaacaggtaactgcaaatgcagagactgtagaccgtttatctgctgaagaaaaagaagtagaagaaaaaatcaaaaaaatcatgatgacaattccaaatatcattgatccatctgttccgattggaaaagatgacagcgaaaatgtggaagtacagagatatggtgaaccggttgttccggactttgaaattccatatcatgcagaaattatggaaaaattcaatggtcttgatttagacagtgcaagaaaagtagccggaaacggtttttactatctgatgggagatattgcacgtcttcattccgcagttatttcttatgcaagagatttcatgattaatagaggatttacttactgtgtaccgcctttcatgattcgaagtgacgttgttacaggtgttatgagctttgcggaaatggatgcgatgatgtacaaaatcgaaggcgaagatttatatctcatcggtacaagtgaacattccatgattggtaaatttattgacacaatcattccggaagaagagctgccaaaaacactgaccagttattctccatgtttcagaaaagaaaaaggtgcacacggacttgaagaaagaggtgtataccgtattcatcagtttgaaaagcaggaaatgattgttgtctgcaaaccggaagaaagcaaaatgtggttcgataaattatggcagaatacagttgatttattccgttctatggatattccggttcgtacactggaatgctgctctggtgatctggctgatttaaaagtaaaatctgtagacgtagaagcatggtctccaagacagaagaaatattttgaagtaggaagttgttcaaacctcggtgatgcacaggcaagaagactgaaaatccgtgtgaatggaaatgacggtaaatacctggcacatacactgaataatacagttgttgctccgcctagaatgttaattgcatttctggaaaacaatctgcaggcagatggttcagtaagaattccggaagcactgcagccatacatgggtggaatgactgagataagataaggaggcagtctttgcacagttatttaaggtccattggtttttcagaactggaaagaaaagaacttgaccagattttgaaagaggtaattacacaatacgatgaaaagacagtaatagaaaactctgagggacatctgtttgtggaagtatcaaaaatatttggatgtgacgttggaatcacagtctgcggagaatacgatgaaaataatgaatttgagatggaatattattttccgttcttccgcggaactggaattacgacacaggaaaatgtgttaattgaacgccatgtgggaaaagagtcctatgccggagcagtggatgatataagaatcggcgttacaattatcttttatctgcaaaatgcagccgaatatctgacagaacaccggcatggacattatacaaagggtgtgtatccggtgactcttgccggacttgcaagagaagccagaattcttcttcctgttaagaaagatgaaaaacagcaaagagaagaacgggagaataccgtgaatcgtaatcgaatgattgcagcagcccgtaatggtgatgaagaagcaatggaaaatctgacgatggaggatattgatacatattccatgatatctggccgtatagcaaacgaagatatttattcgatagtggatacttattttatgccttatggaatggaatgtgatttgtataatatcatgggagaaatcacagaatggtccattacaaaaaatacactgacaaatgaagaaatctatcagattcgcattttctgcaatgatatggaaatggatatctgcgttaatgcaaaagatcttttagggaagccggaagttggacgaagatttaaaggagttatatggcttcagggaaatgtggatttttagatgaaacctgagaattaaaagaaagaatcttgcttgcgagattctttcttttgtttcacgtgaaacatattatcggttgagggtagggttaaattatggtagaatgataccacatgatacaagacagtgtcataaaaactcacaaattcaccaaagataaagtgatattgtgaaataaaaaagaagggaaaaggaaaaaatggagttatttgtcaaagtgatgaatgtagtcaatgatatcgtatggcatcctgtaatgtgcgtgtttcttatgtttgcggcgttgtggttcacgtttcatttaagaggcatgcaggtacgaagatttggcgatatgcttaaatgtctgactgaaaagggcgacaataaacaagatactggtctttcttcttttcaggcatttgcaacaacagttggaggtcgtgtaggaaccggaaatattgcaggaacggcaactgcaatttttatggggggacctggtgcaattttctggatgtgggttactgcaattttaggtgcatccacaggaatggttgagtgtatcttaggtcaggcatataaaacgagaaatctgggagaattaaccggaggacctgctttctatatgtcaaacggaattaagaataaaaaattaggaaagatactggcctttttattctgtatcgcagtctttatcggacctggattcttgcttccggcaatgcagactcagacagcggcaacagcggtaaatgtagcatttggacttccatttgttgttgttggagtgattatgacagcaattgttgcatttgttattatgggaggaattaaacgtatcggacaggttgcggaatttttagcgccggttatgtgtggaatttatttcctgattacgattattattattgtacttaatattggaaaagttcctggaatgtttggttctatctttgcaagtgcatttggaaaagatgcggtctttggcggaatcgttggttcggcagtttcctggggaatcaaacgtggattcttctcaaatgatgctggtaacggaatgagccctttgatttcagcaacaactgatacttctcatccggtaaaacaaggtttggttcagggattatctgtgtatatcgatactcttttggtatgtacttgtaccggaatttctattttgcttgcgggaacttacaacgttgcagcagacggagcaggtgcttctctgttagtagagcatgttccgggaatacagtatggaattgcatttatgcaggaggcaatgtcggtatcaatcggtaaagcaggagcaatgttccttgcaattatgctgtttatctttatttttacaaccatgctgtcctattcttatcagttggaatccacatgtaaatatctgttcggcgagaataaaatggtggttacaattgtgcgtattttattcctggtattctgcatgtttggtattttgattgatggtgatactatctggccaatgggtgatattggtgttggatgtatgctttgggttaatacttttagtatcttactcttaactcccaaggttttgaaaatcgtaaaagattatgagaaacagaaaaatgttggcttgaacccattgtttgaccctgctacagtaggaattgaagataaagcgggggtatgggatacttatgtaaaacagaaaaaagagcgtggagattatgaaaatccgcagcttggatatgataaaaaataagaaacttttgtagagatatactcttgtaaggttttggctataccttcagaaaagatttcgagagtatattaagattacatggaggtgtgcagacgtggaatttgattttaaaaacgaatttgaatctatgatgaaatcgaatgaactggacacggttgttgttttgggacacatcaatccggatggagatgcagccggttctgtgatgggaatcgcacattatattggcgtgaattatccggagtatcaggtattcccttatctggcggatacgatagacaaaggaccaaaacttcaggtgcgccaggataaaaaatttgatccgtttgaaaagccggatttgcagggaaaacgtttcgcaacagtgatatgtgatactgcgacattggcacgtttaagcggaagagaattttatgaagcatctgtcgcttctattgtaatcgaccatcatgcctcaaatgagggctatggagacagaaactatacaaaggtttcggaagcctgcgcggtaaatgtattttatagtttgaatcaggatgatttaaaaaaagcggcagaggcagaagaatatccaaacgctgcagattatatctatcttggaattgtacatgatacgaatgcttttcaaagagcagatgaaagtatcatgaaggctgcgacaaagcttttagaacttggcgtagaccatagacgaattatacagactcggcagattgatacgttagaagatttggaaaaacgtgcagacattttaaaaaatgcgatacgtgtgctggatggaaaagtcgcctacgtgtgtataaacaaagaagaaaaggttaaaaagaatatcagctatgaggaaattcatccaatcagcagtattctgcgtgactgtgcagacattgaactgggatttacaatgtatgaagaagaaccggacaggtggcgttgttctttccgctccgatggaaagtggcttgatgtaaatgaattgattacaccatttggtggaggcggtcatgccggggcagcagggcttagaaaacgaaccggtgatatggaagaacttagaagtcagattcttgagagagtaaaaaaactaagagcagaaaaatgtttcacgtgaaacaaagcggttgtcagtttagttaatgacagccgctttttgttacttgtacggtgtactggtttaaatgtttttaatatagaagcaaggtttgcagaaaccagatgttgcttaatgactgcgttcatgagtaagtagcgaagcggattgcgaatgtccgctttacgagaatcaaccggtgaattataaaatgagttttcattaaatcagtggattgtgaatatttgtttgataaaaacaagatattgttaaaaaaatgtttattaaactagatatagtattttctgattttgtatgttatactgacactagattacagaaaatcagaaaaaacgtgaaaattgcccgtcacaattacgacagtaatagcatttccagatattctatgataatgagtggggatatacatctcagattttcagactcattcagtatatgaatcagattgatactggtcgataacatttaagatgtgacagggcagttaaattctgattttaacgtaacctgctttctgtaagggacatatccattcgttattacgattatgaaccgtaaatgaaaatcggaagccgggagataagtctggcttccgattttttgtatttagatgctctggtaacttagttaccgaggagtttacatagttgtttcgtatgtttgttttctggtaacccagaaaaagacgcatacaaagataattcctttgataatcgatgtggaagaaaatgcccaccagattccgtgcagtccaagggaagtattttttaagaaaatagcaagagggatccttgaacctgtaaatataatactgatgatactgcaaaggcgggtcattccaagtccggaaagagcaccgattgtggtcagttcaatacacataaagccttcactgaatccgatgataataagatatccgactgcgatggtaatcgcttttggttcatgaaagaagattgttgcaattgtatttggcgcaaagacaaatacaagagtgataatcagcccccagatgccaacggtccataaagaagcatgatatcctttgcggacacggttcatttttccggcaccatagttttgagcagtaaaggcatttaaggctgatgcaaaaccatctgcagtattccaggatacggactcaatctgacctccgactcgttgtgtggcaaccgcttctgcaccgaaagcagataccatacgggtaagcaccatcgagataatacaatatgccataccctgaatggcggtaggaattccaatccggcagataccatttaagtaaggtgccggaatttttgtaagtaaatgagttccctttaatacattttcttttttctgcttgataacgcagattatcataatgctcataacgataaactgtgcagttacggttgcaattgctgcaccggtaacgccaagctttggaaatggaccgggaccaagaattaaaacagggtctaaaatcatgtttgtcacaagtccgatgagattggcgagaaatggtgtttttgaatctccttgcgcagtataaattccggttaacgtgactgttaaaaaagaaaatacaatcagtccgcaggcaattttcgtataggacaatgcggctgagactgcttctgggtcattgagcttaaaaaatccgaccatctgccggacaaaaatgaggcataaaatagcgtaagccagtcccataaaagtagatagctgcacagcggtctgcgcaaaaccgtgtgctttttctttttctccccgtcctaaagactgtgcgacttttacctgaccacccatccttgccatggaagccagtccctgcgaaagccaggtaaacataccaccaactccgactccggcaacggcttttgaaccaagcagaccaatccatgccatatcggtgatattgtataatgtccccagaaatgaagaagccatgatggggagtgcgagtttggttaaggtctttagaataggaccttttgttaaatttccatccaacgtatttgtgtaacctccaaattattctgtatatctatgttatcttattttatgaagaaaagcaacgagaaaaaagaaagaaaatttgaaggattcattgagaaaatctggatatcatgatattctgtagtcagaaaatgtcaaaaaggagagaactatatgaagaaaaaatcgtttttgctatcatttttccttgccatgctttttgttgtattaggcagtgtgaatgtaaaagcagatgaaacattggaaggatacacttatgtcaatccaatgtatgaagaccttgaggggaattttgagtttgagtctgattttgagctgtattctgagtctgatagtgaggaatcagatgaagaggatggaattgacacttatgattcgaggagtgttcagtatacgagtgacaagcagagtctgataaagacattcagacagcagttagtcaatcgtgcagaaacaattgctttgtattatcactgtaatcagaagattacacaggatttttttgacgagttctctgctgaactgtttaatggggcagtggcacatacgggtgtaggaaaagagggagattatatcagatggcactaccagggatggcgtgtcaatgcaaattataaaacggaccgcaatggtggatacaatttgaatattacttataatatgtattatttatcagacgcatcacaggaaagtcagatggatcaggcggtttccaatgtgttgaagtctttaaatctttcaaataaaacagattatcagaaaatcaaagcgatttatgattatatatgttccaatatcacgtatgattatgtaaatttaaatgatgattcctatctcttgaagcacaccgcatatgctgcattgattaataaaacggcggtttgtcagggatatgcaacattattttatcgtctgtctttggagtcgggggtagatacgagagtcattaccggagattccggaggtccacatgcatggaacattgtgaagctgaatggaaaatattataatcttgacagtacatgggatgctggttcatcaagctactattatttcttaaagagcatgaatgatttttctaaccatacgagatatgaagaatatcagacatccgattttacgtccgcttatccgatggcagagaaatcttattctgaatcaggaaatcaagagccacttgaaaaagaacataattatggacagccaatgtatgtatgggcgaatgaccacaaatcgattaccgcagcgcgtatctgccagaatgattcaagccatattgagcaggaaacagcagaagcagaacaaacggttataaaagaaccgacctgcacagaaaaaggcagtgttctttggcgtgcggtgtttgaaaatccggcatttgaagcacaggaagaagtggttgaagaacctgcgcttggtcatagctttaaaaatggagtctgcgtcagatgtaatgcgaaaatcacaggacgctggatgaaatcaggttctaaatggtggtatcgctatgaggatggttcttatcctgagaatggattatataaaatcggcaatacatggtatggatttgatgcttccggctggatgaaaacaggatgggctgcttttgataaaaactggtattattttgcaccgagcggagcgatgaaaacaggctggctagcagaaaataaaatctggtattacttgaaatccgatggaaagatggcaaaaggctggcttagagtagacggtgcctggtattatatgaatggaagcggacatatgctgaaaggtttcattacggtaggaaacggaaaatactatatgaatggaagcggaagaatggtaaccggctggaatgtaataaatggttactggtactactttacctcaagtggaaagatggcgaccggctggcagaaaattgataataaatggtattatttaagttcagacggtaaaatggcaaaaaacacctgggtcggaaactggtatgtaaatggctcaggcgtgtgggtaaagagcaggtaaaacaatataaaacaatataaagaagtataaaaaagaaaaaaagaaatcctcggttgctgctgacagccgaggattttctcttatatgattagcctaagaagaagttcattggaacagtaacaatagcagggaaaagtaccatcaataataaaatgatgacttcggctaataagaaaggccaaatggattttaccatgcgttccatgttaattttacctgcaccacatgcaacatttaatacagttccgacaggaggtgttaacagtcccattacagtcattaaaataaatacaactccaaagtatgcaacatcaattccggcagcttttacagccggcagtaaaacaggtgttaaaatcataatcgtaggagttacatccatagaagttccgactaataaaacgattatacagataataaacattaacagtatcggatgattgataaatggtgcaagaataccggttacaatagccggaacatttgcaacagtcatcatccaggatgaaaccatagctgctgcggctaagaacatgataacagaagaagattttgcggcggaaacgaggcagtccattaacatgttaatttttaattctttgtatacaaataatccgattacaagtgcatatactgctgcgattacaccagcttcggttggagtgaattttccacttcttaatccgacaagaataaatgcaggaaggattaatgcccacaagccatcaattaaggctttcaccacttctttggcagactgtctttcagcttttgcgaggttatcttttttggcaatgaagaaccataatacacattggagaaaaaaaagaactgatgaagctgtattcggaattttttgtgaataatgagtaaataaaaatggcgtattaatcccataatttgtgggagttaatacgctgtttttttcgtatattttttgtttgattaacattgagtaaactcagatatcatggtattatatataatattaaacgtgtcggtgaacctgtgagcaagggaaggaagccctttatgattggaggatgatgccatgaaatatgtaattgttgaccttgaaatgaatcctgtttcaaatgaatatccaaacgaacgaaaagtaagcagacttgaaacaattcagattggtgcagtgcttttggatgagaagtatcaggaaattggaagttttgtaacgctggtaaagccagagtacaatactcgtattcagaaacgttatgaaaagctgacagggattaagacaagcatggtagaatctgctccgcattttaaagaagcactgggtatgttctttaactggtgcggcagtattcaggatgaagtgcagattattcagtggagtgagaatgattaccttcaatttacaagagaattgcagatgaaaggaatttcagtatcagaacagaatcaaaagtacatggaacatgtctggttggattttcaggcggaatatgagaaagtgcttggactggaaagaaatatctctttaaaagatgcgattatgtatgccggagaagattttcatggtcatcagcatgatgcactggttgacgcgagaaatacggcctgtctgtttgggattgtaagagatgaagagaaatgtgagaaagcgttgaaacatgtcatcgaggtgttaaagccaaaaacggaagtttcccttggagatatgtttgacttctcgggtttgtcgttgtcggcataagaattaaaaaaagctgcaaagcgcaaagattaagaaatgatatgcgctctttgcagctttttttgacgtatattcgcaaaccaagctgccactcattgcccgagtgacagcttggttacttgctatccctgataccttattctttcaaccagcgtttcctttttcagattactgcttaaaacgcaggaaagtacaatctgcaacagaccgaccaaaaaaatcataataaaaattggtacgattggaacatgatagatattcattccaaatattccaatatgttttgcataggaaaaaagtgcatatccgagcggcagaccaatgatcaaagctacgcatatggtgccaaccgtaaaaatcagtccctgtaactgcaggcataaatttaattgtttattcgtcatacccacagcctgtaatacaccatattcctgcttttttgtcgtaatattcataatcatggtgtttgccatattcataaaaccgatgagtcctacaaccgccataaacagataacagccaagcttcatcatgcgggctgcgacttcggcagattgtaactgtgcatgataggtatccatttttatatgtgaagtattagaaatcaaagtattcagactctgttccacagatgccacatcttttttatcacagtccacccacagatagccataggctgttcctctcggattcatggaacggtatacaccttccggaataacaagataagtctccgcacttacaaaggatcctgcaatctttccctgataggtataggttccacttccattctcaaagtcaaatgcaattgattcacccggagcatatccatcttgttccatccacgtcgaccaaccaaagaaaatatcaccattctttaccgcctgatcatagtccatagagccaatatctccgtcttggcgcataaaatcaaaatcctttttactcacaatagcacccggaaatcttgttccattcagatttacagaaacaatctctctcgtcatgacatctgtcactcccggaatgcttttgatttcctcaatcagcgaatcattcaatggattatccgtcagaatcgtatccagattattctcaggatatctttcatcatactcagcagaatagtcaagctgcagttcaaattgtccatgattaacggaaagacgtgcttcatgctccgtgtcaatatttcccacataattagagataatcacaaacaatgtgcaggaaagccccattgtgaggatggtactaatggttcttttttgattacccgttacatttgccattgccatagaaaacacggtgacattttttctgccatttcgttttccttttttgtgtgtttcagcattttctaaataccgtgttgcttcgataggcgaaatccgtgaaacaattttcattggtttacgcagcgccaaaacaacggtaagaaatgatacgaaaatacatagaagcataacaggcagggaaaacagtggcacctgctgattttggactcccatagagccagtttcggttgatacaaggtttccctgttctaccagccagttaaaaccgcattttgcaatcagaaaaccaagaagcaatccaaccggtattgaagaaattgtcaaaaaaatgccctctctgaagatcagttgtttcatctgcttttttgtcgctcccagagccttgatttttccatactcctgtatcttgttggcaataccgacctgaaaaatattataaatgaccacaacagagaaaagtacaattgcaagaatcaaaaccccgcataccgcaatcgtttcataactcggctgcaagacccattgcaaatagagatcattgactataacgtttttttcttcgatcccacaagttgctgcaatctgctttataaccgaatcaatattattcatagatacatttacagaatcatttaaagtaaaataaatattatactgtctgtcattctctgcgacgtgttcatcataaaactcctgtgacccgaaagcaacataagatgcctcgatggtatactcatcccgatcatataggattccgctgacaacaaattcttccggcttatattctgactgcatccctgcgcggtaatccagtgtaaccgtatctccgatctttacatcaccataccccattgcacgaaaaaatgctcttcctgcggcaatttcctgcattttttccggatactttccttccttcaactcatattctttattataaggaagcatttttcttgcagtctcatccatgcagacaaacccgcctttttcattgccttttatgataccttcggtgcacatagtgcctgtagcatctatttccgcacggaggtttacttcttttaattgcgatccgtctgcggaaacaaacagaccataattgcttccatatgatcctgccgcctgacttttctgtaaatgaattactccatttcccacagtactgatgataacaagcagcatcgtggtcagacagattgccatcatgatcagtatacttcttgtcctgttccttttgtcattgctatatgcaatcctgcttattgtcttcatctgaaatccaccacctgtccgtcctcaatcaccagaatacggtcagcgacctgtgcaatttcgtcatcatgggtaatcattacaattgtctgtccatatttttttgctgtcatcttaagcagagcgattacctcatcactggtcttagaatcaagatttcctgtcggctcatctgcaaatataatttccggacgattcaccagtgctcttgcaattgctactctctgctgctgtcctccggataactgatttggcagattataaatccggttttcaattcccagagttgcaataatatcatttacatacgcttcatccacttttcttccatccagccccagtggcagtacaatattttcccagacattaacagatgaaaccagattaaatgcctgaaaaacaaatccgatttttcttctgcggaaaacagcaagggcatcttccttcatcctgtataaatctttccctgctaaagtaacactgccttttgtcggggtgtctagccctccaagcatatgaagtaatgtacttttaccggaacctgattttccaacaattgcgacaaattctccatgctcaatctgaatgtccacctgattgaccgctttgacctgattctcacctgcaccataaaacttacaaagctgcttggtttctaatattacactcatgtgttgcctccttttcatcctacatccaaattgtatcaggacaatctttcatttcactttcaaaaacgagcagaagtcttacagagttgtaagatttctgctcatttaaaatttaactaacatatggtaattgaatcacaaacgtgcttccttttttctttttgccggaggttaccgtaatcgtacctgcgtgtttttcgataatttctctcgatagaaaaagtccgattcctgtaccactcttttccatgacctccttggaacttcctctgtaaaatcgttgaaaaattttgtgatactcattctgcggaataccaattccctgatcttcaatttccattcttacaagatcgtttcttttttgtaaccggataaatatttttgaaccacacggactgtacttgaccgcattatccagaacgttgatcacagcttcaccaagccaccttttatcctgcataatcgtgcatgtttccagctctttttcatagtcaaaaacgaattcaatttctttctcatccgctttaggataagtgcggttcacagcagatatgacagtatccataagcggaagttttttcttattcatctgaatcagtccagtttccatcttggatatttcaagaagcgactgcaataatgtctccagtccatccagagcactccgacaacggatacgaaactcctcctgttctgtggcacttaagtcattctgcatcagcacactaaaacatatatccaaagctgcaaccggtgtctttaactggtgtgagatgtcagaaaccatttctttcgtgctttctttttctgtccgtgcttcttcctttagcaactgaatatgatgtccgattgcttcaagctggtcattcaatttttccagttctgcatgattttccgttttcagtaaatcatcaaatttattttcacggaatctgatcagaatttcttccaactggtctaaaattttctgatgacacgcatcttcttttttcttccaataaagtaaaaaagtcaaaaaaaacacgcatatcacagtgcttacagcaccggtcaccataacctgatgccggaattgtgaataaaatgcattccctttattcccccagtatccatattgctccaataattgctttccctgttcgttggtttcaatatccttatccttaagcaattccgaaacagcatccagcccggaaaattcttcctttgcagcaatctctgtcataagattcattttatatttataatcttcataaaacacatacgtggtaaagcaatttaatattgcaaacaatactatgacaggcaataccaaggagagtactactgtgatcttcttgcgatatctctttgtcactgccttacctcctgattccatatatacccaagacctctgatattctttatatagaccggtgtagccggattgtcttcaattttctcacgaagtcttctgatattgacagcgattgtattttcatccacaaaatccccttccagatcaaacacattttccaatatttgtgtttttgaaagaatctgtttcggattctgaagaaaaaaagtcagcattttcaactccgtttttgtcagactgatttcacgactctttatcaggactttcatttctcctgcgataaatacgatatctcccgaaatcatctttccggcttccgttttctcctgtctgcgacggaaatgtgcttctattttcaaaagaagtaccgaaagactaaatggctttgtaatataatcatctgcccctgcttcatatcccataacctgatccatctcctgatctagtgctgtaagacaaataatatatgtattataattgcatctcatccaccttacaaattccagtccattcccatccggaagattcacatcacaaatggtaacatccacattattatcacttgcaattctttttgcttttttcactgattctgctgaaaaaacctcatatccggattttttcagtgagaatgtaattccacgatttaaattttcatcatcttcaaccacgagtatatttggcatagcatatgcacctctctttattaactatatatatttaatatcagagtagatattgtttttataacatcacctcaacgtacttcatggcttgattttgatatgattgaatcgttccatcgtctgaatcaaagactctacgttctgaatttcatcctcatccagataataccgcttatctgcatttatcgttctggttaactgcatgaaaacactccttttctcaaaataattcgtcggttaaaaacataacaataattgaaatagtccttgatttatagtataattataacacaaatcaaaccattttacaatgtcggttaatttttagaaaggagaatttatggaaaacaaaacttatactagaaatgctcactcggtctgctgtctgacctattacgctgttttcgtcattaaatatcgaagaaaagtaatcacaccagaaatccttgcttttatgcgtagtcacacagattacttaatttcacagcgttatcatggaacacttttggaatttaatggtgaagaagaccacatccatatcctatttgaacttccgccatccgctgcaccttctgttattatctgtaatttaaagactcagctttcaaaggaagtccgaaaacgcttctgggaacaaattcacaatcaattatggaaagattctttttggagtgacagttacttcttatcgacaactggcggtgcaaatttggaagtattagaacaatacattcaacaacaaggaatcgaaaaacaaaaacggaaatacgttcatcacaagaaaaaatgagcattcatccccaaccgactcgtcggatggggttttctgctctataatagataaatgtataaagattttgcacagttcgtttttttcaaaaaacttattctgtttttcaactcctgtgatataatgctttattataataattcccattgacaaaatgaggtgaaccaagtgaaaaagaaaacacttgtgcctcttatcatttttttactgggcatatgccttgttagtttgattgtatacaaaacagacacccacgaaaaagagcagagacacataacagcacaattaaacgtagccacctatggcgaacaaataaagaatgaaattacaaatggaattgagatcacagataccttgaagcaaatcttaataagtgaagatggcgaaatccatcagtttgaaacaattgcaggaaatcttatgtctgattctattgaaagtgtacagctcgctcctaatggtgttgttacagatatttatccggctaatgaaaatgaggcaggtaagattgatttgattcatgataaagaccgcggaaaaatttcctgttacgccagagacaaccatacaatcattacgcagggtcccttcaaattaaaacagggaggatatggaattgcagtccgcaatcccatatacctgaaagataaaaacggacatgagtatttctggggatttactattgttatcctgcgtgttccggatattttttcagattcaatcagtgcactttcaaattttggatacgaatacaaaatttcaaaaacagacgctccatggagtgatacttataaagtggtttatcaatcagatgggcaaacaaatcatcctgtttcttatacatttacaataggagatgaaaactggaaatttgaagtaagtcctaaaagtggatggagaaatgccactctactgataatcatcatcggaatgtttcttacaataagccttctcctgtcagttcttaccagaatatggttagtagaaaatgaacataagaaaaagtttcagatactggcgcgcacagattctcttacaaatatttataaccgctatggatttgatgaatttgcagaaaaaatgattcaaaaaaatccaaaagcacattttgtggctgcgctccttgatatcgatgatttcaagtttattaatgatatctatggacataattacggagacagagcactaaagaatcttgcagacagcatgaagacttttttcccatccgatgcattacttggaagaaatggtggtgacgaattctgcattcttttaccaaattgtacctttgcagaagcagctatacagctgcagaaattcaccaaacttcctaaatcattctcataccatggtaaggaacatgcattttatatttctctaggatatgcagaatatccaacatttgcatccaatcgttcacagctcatgcgctgcgcagatgccgctctttatgaaataaaacttcatggaaaaaatggatgtatggtctacagagaaggaattcggacaggtgcccgcaaacaacttggattcgcattcaaggatatctctgaacatcttccaggtgcattcatcatatacagagctgacaaagaagatgatgaactattttttgcaaatgatgaatttcttcatatgtccggatataaagatatagatgaactgttcagacttactgagaaaagttttcgcaacttgattcgtgaagatgaacagcaacagatagaatcaagtatctgggaacagattgacaacggcaataaaaatgactatattcactttcatcttcgaaaagctgacggaacttatttttctgtgcttgatcatggaagaattgtagagaacccgcaatacggaaaggtattttacgtattgttcatggattggaaagatatgcatattcgttacaatgataaattcgcaagataataaaatattgcaaaaaaagagagcgtatgatctattttcatattaatacttggtttgaaaactgatggaagaataacacgatactgcgatagaataaggaaaacggttaaactaactattgctgagtgagcaacagcaaaagtaagcatgactggaaagtgcttgtgatcttagggattaagagaggatacagattatggaagattcttacgtattacaactgttgaaaccaaagtttaaagattttcatttgtgtttctgcggatttgcagaatgcaagccattacatagctacgggccagccgcaaggtccaattatattttgcattatgtaatgaagggcaaaggtatctatcaggtaggtgaaacgaagtatccgctgaaagaaggacaggcctttctgattgaaccggaaagccttaccttttatcaggcagataaaacggacccatggtcttacctttgggtaggatttggtggtacggaggcacagagatttgtcagagatctcggactgaacagtcgtcagcttacatgcgagtgtgaatatggagaagaactgaaagaaattgtatttgaaatgctttatcatacgagttcaactgcagaaaatctttattatctccagggaaagctctatcagtttttctcagtactggctcgcgggattgaaattcagcaatatgcggatgatacaaaagaaagtatacatgtgcagaaagcaattgcctatataaagaattactattcacagaaaatcacagtggaagatatagctgattatctggcacttaaccgaagttatttatatacaatatttcagaacagtcttggaatctcgccgaaggattttttgacggaatttcgaatttccagaggaaaggagcagctcgcacttacagatctatctgtggaggaaatcgcagtttcttgtggttatcgcaattcacttgctttcggcaaagtatttaaacagaaaatgggaatgacgccgacccaatatcgtaatgataacagaaaggctgaccgagaacgattgatcagtgcacaaaacgaactgaaagaatacaagaaacataaaaaaatttatgtaggagacgtcgaaaaagaatagacgaaatgttgaaaaagacatccgatacctaacatttgggatacaacacttaacaaaaaggtataacggatgtctttttttgtacgctatacttgtatcaacaaatataaggaacaagtgcacaggtttcttcactcaaataacaaataaacaaaggagtattggaggaggagaatcatggaaaatcaaaaagaaactcagaaaaatccgcaatataaatatgtgtctacaagagaaaaattatgttttggaattggagcaatcggcaaagatgcgatttgcaatttagtaggagcatttttaatgctttattttacagatactttatatttggcaccggcatttgtcggcgtactgtttttggtagcaagaatatgggatgcgatcaatgacccaatgatgggtatgattgttgacaatacacatacacgttttggtaaattcagaatctggcttgtaatcggaacattagtaaactcagttgtatttgttttattattccacagctttaatctgtcaggaacagcattgtacgtatatgtatctgttatgtacattttatatggaatgacttatacgataatggatgtaccttactggtcatggcttcctaacctgacaaatgacccgcgtgaacgtgagaaagtttccgtaattccaagatttttcgcaagtcttgcaggattttcagtagcaacatttggactttatattatcaattacctgaataaagttgcaggcgagagcaatctctacgcagaaaaaggatatacactttttgcaattattatcgcagttattttcatcgttacaatcggcattactgtatttaatgtaaaagaggaatcaacagtaggtatatcagcagaaaagacaagtctgaaacaggcatttcatgtaattgtaaaaaatgatcagttgcttgcatttatcggattacttttgacatttaacctttgtacacagattgcaaaaagctttgctgtatattatttcaaatgtgtatgccacgatgaatatctgtattctatctttggatttgcaattattgctgagatggcaggacttttatgcttcccaaaaatcgcagcaaaaattaaccgtgaaaaagtatacgcatttgcatgtggacttccaattgctggatttgtactgctcggtgcagcaggatatgtagcaccacagagtaaggtgttagttgttgtatgttgtgcactgcttttcttcggatcaggtctttcacttggagtaacaacatgctgtatggcagacgttatcgactatggagaagtaaaatttggtgtacgaaatgaaagcgtaacatgctctgcacagacatttcttatgaaggcagctacggcagcagcaggtggattaacaggaattggtcttcagattgtaggatacaacgcaaaagcggtaacgcagagcgcagcaacagtaatgggtattcgcgtgttaatgattgtaattccaatcattcttgcatttgccagctttggtatttacaaaaaatactacactttaaaaggtgagaagatggaagaaatcacaagaaaagtaaatgaaatgcatgcgaaaaagcagacagcttaagagtcaacaattcaattataaaaggggtagtatatgagacagattatttttcacgaggaaacgaaaactttccatttatacaatgaaaaaatcagttatatcttatgtgtattagaaaatggacatctgggacaattatattttggaaaacgacttcatgataaagcagatttttcttatctggttgagaaatgtgaacgcccaatgacatcgtatatatatgagtgggatcgtactttttcattggaacatatccgacaggaatatccggtttacggtacgacagattacagacatccggcaattgaattgttgcaggaaaatggcagcagaatcagtgagttccaatatgaaagctatgagattattgccggaaaaccgaaactctccggattgccggcaacttacacagagtccgaggaggaagcgcagacattgcgcatctttctgaaagacgctttgactggtgcaaaactggcgcttttatatacgatttttgatgaatatagtgcaattgcaagaagtgcttatattgaaaatgccggtgagaaaaatctgcatgtattaaatatgatgagcttaagtctggatctttcggataaggattatgaatggatgcagttgtccggtgcgtggtccagagagcgctatattaagaatcgaacattggagcaaggcataacagctatcgacagcatgcgcggaaattcttctcacgaacataatccgttccttgctttaaaacgtcacaacacagatgagaatgcaggagaagcaattggaataagccttgtatatagtggaaatttccgtatgcaggcagaggtagatacacataatgtgacacgaattacagccgggatcaatccagaaggattcgattggaaattagaaccaggagaaagctttcagacaccggaagcagttctggtttacagtgaaaatggattaaatggcatgagtcagacattccagaagctgtatgcaaagagactcgcaagagggtattggcgcgataaggcaagaccgattttaaataacaactgggaagcaacttattttgactttacagaagatcgccttgtagagattgccgggaaagcaaaagaatgtggagtagaactgtttgtcttagatgacggatggtttggtgcgagaagaaatgacagagccggtcttggcgactgggtggcaaatgaagagcttctgccaaatggcatcaaaggtctgtcagaaagaattgaagcacttggattaaaattcggcctttggtttgagccggagatggtaaataaagactctgatctttatcgagcacatccagactggattttacagacacctggaagaaatacatcacacggcagatatcagtatgtactcgatttcgcaagaaaagaagtagtagattatatttatggtatgatgacaaagttattatcggaatcgaaaatctcatatattaaatgggatatgaaccgaagcattacggaatgctatagtagcaaacttccttcagacagacagggagaagtgttccatcgttatattttgggtgtatatgatctgtacgagcggttgacaaatgagtttccagaagtattatttgaatcctgcgccagcggtggcggaagatttgatccgggaatgctgtattatgcaccgcagggatggacaagcgatgattcggatgcaattgagcgtctgaagattcagtacggaacttctatgtgttatccgctcagcagtatgggaagccatgtgtctgttgtcccgaatcaccaggtatttcgcaatactccattacatacaagagcgaatgtagcatactttggaacttttggatatgaactggatctcaacaaattgacagaagaagagatcaaagaagtaaaagaacaaatcgcatttatgaaagaatacagagaagtgttacagtttggaacattttatcgtctgaaaagtccatttgaaggaaatgagacggtatggatggtgacaaatgaagaccgcacgcttgcaatcgtaggctactatcgtgttttaaatggagtgaatcagccgtatagccgtgttagattacagggattggacccggatatggtttatgaaaatgtatggaatcatacagaaaattacggagatgaattaatgaattatggattgatcacatccgatgtgacagctggtgaagtgcctgggaatgtgactccttgtaccgattttgaatctagaatatatatgctgaaaggcaaaaaagttcaggagggaagatagagcatgacgaagacaaaaagaatcagtggaatggtactgggaatattgtttattggattatgtgtatctttcttacgactttcacaatttggcgtggatccattcagtgcaatgaatctcggaatcagcggatttatcggatggagctttggaacgtggcagttgcttgtcaatgcgatcattcttgtagttgtattctttcaggcaagatcctgcattggtgcgggaaccattatcaatatggtatttgtcggatatattgcagattttatctgttatgtagcaaatgatgtagtgcagattcagatgaatctgccactgcgtatccttgcactgctgattgctcagctgatggcatccatgggagtggcattatatatggtcgcagatatgggaatcgctccatatgacagtgtcgcaattataatcgagaaactgacacatcaaaaaatcccattccataaagcaaggattctttcagatgttgttgtcgtgattatcggaatcatatttgccactgcatctggggcgggaatctggtcggtagtagggattggtacaattataaatgcctgcttcaacggtccattaattcaattttttaaaacaaaactggagagattttacttgtaaaatctaaggattacaattctccaattcttgcaaggctcatatccagaacggatacgggcctttctttttcaccagtagcttcatccaaaccttcatattgaataatgaacccttctctttggtaaaaagaaattggatatcttcctcctatatgatacatataacagcaaaaacaaaacatccaagagacggaaggagaatatgttatgaaaaaaatattagtagttttattatctctcacattaatatttgcttttacaggatgcacttcatccaataatggagcaacagaagatatagaaattaagacacaggaagttgtaacatcaaatacagatgacaatgatgataatatcagtaacacagaaaacgcagtagagaatgcgaacgaaaaggattatgatttctcttcttatgaaaacgatatccgtaatataacaaaaagtgtaaacaatgcaaaaacatctacaaatgcatctgagaatcacgaacaattctacgctttgaaaaaacaggtagacgcagtcgatgacgaactggataagcttgacgatgaatttgagtatgcttaccagatgaaagagattagcttcgagacatacaaagcgagagaacgcacgattgaaagactggaagatgaactggaattagcagaagaagcactggaaaataaatacggaattgatgattaattccatatcgacttcttcagaaaccatatctgtcagggaataaccagaatcgcccggcacagattttatatcaccttcttgaattttacttggaatggatgcttgcgaaatgctttgagtcgttctactatggtttcgactttccagttactttttatcttttcaattacgccggagtaaacaaattaattcgattactaacacaagtgatagtggcaccatatgaataatcgggtattatgaatataacataatgaatagaatattcttaccggggaggcgaaaaaatatggataaaaaaaagaatgaaaaatgggaaattgtaggcgtatagctgttatttattattggattggttggatgcatcttctgcatattcaatgaaattaataaacaaaaagagtttgaaaattctactgatattcgaagtgtgagtgcagttattactcaagcaaaagaagataaagagtctagcaggataataaaatatgatgttaactattcatatgaagttgaaggggaaacttataaaggaagaggcaccgtttatcacagagttaaaataggagatgaagacactataactgtttatcgaacttcaaagggtaaatataaaatagaaccaatagacagtccaatcgagattcttatagctactataggcgctgtgctttgtatatttattctggtagctatgacggttggcagaatattggaaaaacgagataaagagaagaacgaagaatcggataataaagggaagaagtcaaagagaaaatagtaaatgactaagagaagaggatgtagaaattggggagattatccggggcggacagtctccctaattatcatatagtagttttaatgacggagacattatattaaatacggacatagccggtggatggacctgcaccgaccttattatcaatcaccgtcttaattctatccggcttggaaagattatggtacttcaaatgctctacacggctttcaaattcattgtatgctttcagtatgatacccagataatatttaacaaaaggctcataactgttttcgccctcatgccagccagtagaacttgcttgaagagcttcataatatgtttcttttgtcttttcaatcagcatttccatactgacatattttccaacgatatatcccgccttataaaaaagcagtaaagtgagcaaacggctcatcctaccatttccgtcattgaaaggatggatgcacagaaagtccagaatgaacataggaatcaaaaccagtttatcaatgcggtcagcttcccatgcttcaaggaagcgagcgcaaagctctttcatcgcttcagcagtctgaaatgcgggaactggaataaaacgtgccttctgatggccctcgacatctatttctgcaattacattatcggaattcttataacttccaccagcagccccctgtgaataggagtacagatctcggtgtaactgcaaaataatgttcgattttggattgatatattcatagccttcgtgaattgtggaaagtacctcacgataaccagcaatttcctgctcagatcggttgcgtggctctgctttctgacttaccagttctttcaaacgtttatcacttgtaaatataccttcaattcggttagatgctcccgtactttgaattaaagcaacttcgcaggatttgtaatataatcaaaatttctcattgaaatctccttcattttgaatttatctccattattttaatgctaaatgatggagatttcaatggatttgatggagatatattctccatatgcacaataaatatattaatttggatatagaatttattacttcatcgtcttcgccagtgaattgagtaacgcccgcatctctggatttgccaatatttttgccagaagttccggatcgacttcatcagcaacagtagtattattgttttcctgctgactcctaagatttcctgtaactcttgaactgtataacatcttttttctgacatttctttatcctctgttctttgaaatatgaaagaaaaattatcccttcatataacgaaacgctcagagcatgttttacagtggtcaaaagcaagttttttgagatttctgcatttttcctgaaattaagtaaagaatcaggttgtctttacttaatttccactttcaaaaaataaaaaaattttgtttttgaaagcggcatcttgcatatactattagcagacagtatatggattatgacagagtatatgggaatttgaatccatacactctatgatttcataaacttgaatttatcgatttctttattatctaatctgttagtaatctatccaacagcatctgcctattatttataaatatttctgttacctggtaactctctgtatcctcatattcgcacagatgtatgcgtccattatcaaaacaatagatatctgcatctggtattcctaacaaaattggcgaatgcgtaactataataaactgtgctccctcttttgcacatctgtatatttgcatcaacaatgtaagctgtctctgcggcgataatgcagcttccggctcgtcaaaaagatacaagccatttggattcatattattctgtgctaatgcgagaaaactctctccatgtgatttttcatgatatttagcggaaggatgtgtaatatctgcatattcttcttcctgcgttgcaacattataaaagctttctgccctaagaaaatatccccacttttccttccgatagcctttggcaattcttatcgcatcacacaactctgaatgtgtatcatgcgtagaaaaaacataattcttcgttccaccctcaggattaaaaccatgtgctacggcaagtgcttccaataaagttgatttaccgctgccattttcccctacaaaaaaagtaattggtttgttaaaatcaagtttttcaactcccttaaaagccctgatttccttcagataactatccttatcaattttatcccaatcaaatattactctttgtatgaattgatcattcacctaatcatctccttgtaaaaaacactttctaatccccatcttcttgtcctttagacaagaagcattcttcaccttcagttcggtcaatcccgatttctatttttgtttccatagcatggtgtactctttttcaccagtagcttcatccaaatcttcacattgaataatgaacccttctctttggtaaaaagaaattgctctggcattcttctggtatacatttaatcgtaagctaacttttttatccttaatataatccaataaaagtttacctatgccacatgactgcatttcatcagagacaaaaataccttcgatatattcatcatttagtcctacaaatccttgtatctttttatccgcttcaaacacatagatttcggattgtaacatcatttcttttactagttcataattacttttccagtattgattggaaataaaataatgtgctttcagatttgtctttaaccatatgtcagcaactctatcaatatctccgttcagcaactttctaatcataaccaatattctccccaactacatcctttatgcttttctctttttttcattctatcacaagctcaccattaatcattatttttttgatattttttcttttcccccactgcaaaacaggctctgagcgtttcgttatatggaggggtacatatacagagcaagatctacccatgtattaccgtatcgccattttatggctacggcatacctccgggtaagtctcttgacggggattccgattccccataccctccttgtacagacatcaaagatatctgtaggctctctatcaaagataatcgcagcactttatataaccggaagggacagccggttaaaaagtgtaatcgcacatccaagatgtcttatctaaaaggaaggaggactatggcacctaagaagaaagaaaagaatctcaagagaagtaacatcatcacattaaaactaacggatattgaattggcagtgttaaatgaagctgctgactgttttatcagaaacattcagtcgttcagccaaatccttttgagtcattccattgacttttcgtaaagcggcaataaaaccgccgatggttttcttttccatattgagtcctccttttggataggtggtttgctttctacgtctttattctaagattttagtagtgagaataccacccaatagactcagaatcactctcagaatccgagaattgactgtttccaggcacaaacaactcaaagcgacttaaaatgccaagctattcgcattcaacaagaaatactttattcccatgatgacaaaaccttcatcatttctccaaggcttcttactgccatttacaatgacaatcttcttaaaagagtctgggatattacgcagagaattaaactcctgagtctgcttttcttccgaagtcatgtcataagcaacctgaatgtaatacctctggttgccttggttcaccacaaagtcaacctccagctgcttacgaacacgcttgccctctttatccttatcgaagatgtccacgacacccacatcaacattgtagtcacggatcagcagctcgttataaacaatgttctccatgatatgagtaggctcctgctgtctgaaattcagacgggcatttctcagtccaagatcagtaaagtagtatttcagatttgcaccgatatactttctgcccttaatatcgtatcggcttgccttggaaatcaaaaaggcatctgtcaaatggtcgatatgcttggagatggttttattagtataagtcatctggcgctcactggcaaaggtattggcaatctttgaagtacttgaaacacaccttaggatctcttagttcctcattttcaataccatccaatgcaatctcaataatatgatcagtatcaacatcattctccagtaagtatctcttaaagatagtaaacagcaaaaaggatttgccacatctacgaatgccggtaatcacctttatcattccattatcttttcgctcaatcagcctgctatatcgttattatagttaagctgaaacacggaggagatttcaaaggggcactatctttttggagaagtataagtgatgcttttgtccaaggaggtttcttatgaaaaaatgttttctttagtcctttgcactatccttactcctttctttgtctactactggctatgcagcagtaaatgatgattgcaacaatatcactattgacgttttgaagaacatttttattatgacggagattgtagaacagaaaattgtatcaggttgcaaaaatctttcctgagatcaagtaaagaaaaagagcatatagatgaaccgccccccagaagttagacccaaaaatctaactattggaggtcggttcaattgtaggctctttttttacattccaagagttttgatcactacctgtgccagaattctggcaagataatcattggggtgatttaaccagtttccggttatatcaatgtatcgttttctctttccgatttctttttgaactgcctgtatatctgctatagcaactcccataccttctaagcccttcagactttcactgtattcatcctgatgtgcccagaaatggtgtggctccgtagcagccagttcattgggaagcgtagacgcaatcaataaaaattccgttttcggactaaccttccggattgcctctatgagtctgcctgttttatttctgtattcttccataccgcaacggtcattcattccaaaaccaagaataaccagatccggatggaagttggctgcacgctgtgatgaattttcgattgcccattcggaatccactcctcctaccgatgtgttgtggaagcatactggactctgccatttttcctccatctgatggaacagcagttctgcccaggtaggctgtcccggcttctgtccatacataccgctgcagtcacagccacagcacacgctgtccccatacaaaacgatcttaacgggttctcctacttccagctttgcagagagcttcggcagtttgtccagttgactttccggagcggaaagtaactccttcttcgttgccttataggtaacggcgatctgtttctctgtaacaagcttcggattgcctatggcacataggtttaagaattttccgttggtagtcactagcggaccgaaatcttttgcaaattcgcttgtttctcctgccttctttgccgtatcaaagtccggataaaggaaggtatcccatccggttactggtatgtgactcccttcaggaattaccagctcatctccctctacaaggtaatcgatccccttttcatatactgtttcccggtcatagctttctacggacaaaacttcttttggagtccacaggaaagaagccctgcatccattctcatcagcaactgctgcaaaggtttcccggaagcaatactcaccttcccatatcggctccagccattctttatggaaaatctttcctatcgaaagggttttcttgatctgttcttgtaaaaattccttaaagggtgtcacccatccgcagttcactaccggtctatctgacatgaagatcatctcacagggcttttctttttcatatggataccagtagggcattggttttccgtccgcatcattgccgtttggatcacctgtttttatgaaattcacccagtaattgcacatcattctggaaagatcgtaatgctgcccaacaaagggtctccagcatttcgccagtgtttcaaagaaaaaccataaatctacagaatggaaggttccggcattatcccatcctggaatatctggatcaaacctgtaataatagtagggctttttttcacctgcactttttttatctgaaaaaagacacttgatcgtacattcaattccgtttaccttcgcatactttccatcagaatcctcccgcattgcctcgggaaagcgcaaaaaggtctcagcattctttccgaaaatctcttctgccttctttttcaaatcttcttttgaggaagcttctatataactgggaaattcatctgaagtatttccagacataacgggaacatttacatgcttgccttccatgaaaagaaccattgggtcacctacacagaacttgtgatccaatacggtaaacatagccggaaatattttggtatattcctcatacttgtcacgaatcgtagccgcatccagcttacgagcctgctcaatagttgagcaacccaggaaagaaagaaaatgctgtccgttttcctcagcatgccacaattcctccggcactccgattcctccaacctgataaggagagcgaatcattgcactcatcactactgcacgatgaaataagcctttattattcatacatgccatctggctcataacacttccgcctccggctgactgtcctgcaatggtcacattacccggatctccaccaaagaaagcaatatttctctgtacccatcgaagtgctgcctgctgatctagacttccaaaattagtcggtgcgtcagggtgctcctctgtcagctgaggatgtgccaaaaatccaaaaacattaactcggtagtttaccgttacaactaccacaccgcgacgtgcaattctctctccgtcaaattccatttcggcaggatatccacactggagtcctcctccgaaaaaccataccaaaaccggctgtttttctgttacttctttagcacctgtccatacgttcaaatacagacagtcctcatccatggcaatttccggatccacatgccactcacggatatacacgttatcaccgattcccgggacgctctgcatggaaatcggagcaaagcgatagcattcacgaactccatcccagtcttcacagggctggggtgctctccatctgttttctcctaccggaggagccgcaaaagggattcccttaaatgcagttatcctagggtctgcggcttcaatacctttcacccatccattttctgtccgtactgttctcagcataattcctacctccgctaattttactattagccatgagcaaaactccacatactcagtatttatgcatgtttgcgaggcatggcaacctctctcaatgacttataagttactacagcacatgcaataacatagattatgataactcaaatgatcttaatgcagcatttccgttaccgcgataggtcaggtaaagcgcctgtattccatccggaatcgtaatcggtgcggtatatttttcccagacattggtatattgaacctctaatgtcgccagtacctctccatcccatgctgtctttacttcaaaagtgccatctgcatagccccggatccaaatactgatttcacgaatatcatggcagtcaaaatatttgaagccgatagtagttgaatctgtaatattggcaatatatccaacttcttcgtctccatccctgccgtcctgcattactcgtggaaaattcccttcgcccacataaactgatggggtatcggtaaacagattacatgcaagataagcggggtattcgcctttaccctcaagcggacctccatttaaaccgcaggaggtaatttttacctgtggaatactgccgtccggcataatctgaagcttttcagcacatccctgtctactgtaccaggtattattggtatgcctgtgataaaaaatgtaccagtcctctccgatctgcacaatacttccgtgattattggcaccgtaagctgttggcatatctgccggcttgtaggtatcgatgtgcagatcacaattgctgacaataactccgccatagacaaagtccctagtaggattcttgctggtggcataacataattcgtgcattaatatggatgaatagacaaaataataggtgtcacctactttacggatggaagatgcctcaaaaaactcatgtccctcaaatccggtaccggcaccatattcacagccggggaccacaaacaccggagcttccctgatcgtcaacatatctgctcccaacaccgtagccatagctccggtacgggatttatcaccttttccgcaagctccggtataaatatatgtcatatctccttccgtcagaacccccgggtcaaactggggctcatcaccttccttttcgcccagacgtgtgccatcttcataatgaacatagccataaaattcatactttcctgccggagtatcacatacagcaactgaaactaccgaaaccttgtccaacacgtaataaagatagtaccttccgtctggtcccaccgtaacatccggggcatacagacacattttgccttccgggttcagcggatcggctgtcttcggataaatcacaccctcatatctccagttgcccaggtcatcgaccggagctgaccagcacacatagtctcccatgcagaaaacatatccgttaaagtaatcatgggatccgtaaacatatacgcgatcgccaaaaacataaggttctccgtccggaatatactcccaggacggtaaatatgggttaaacgcttgttttttcactttgatattctcctttgcaagcctaattcatgtacattgtttcataaagcaaattactgggtgctagtttaagccttcaagctgaccacacgatcatagtcatatcctcgatctggattcacctttccggcattcagttcgaaataaaccacaccgttttcgtttacaggaagctctacgcagatatttccgtcctcctgctttttacgctctgtttttacaaaaggtctggatgattcccgaatcagcttcgtctgttcctcactcagattggcaggttctcccatatcatgccataccttcaagggattacatgtttcctcatctaccgtcttagtcaggaagcagtactcctcctgttcagccggaaatgtaaactccaacagcattttttctttaccctgttctgtacttttacgggcaatattccaggctacacctagataatcaccgtttgcacgtttcaaaacgacaatattgtcatccttatatacacaattggcttcactttcctcaagctttttgtaaaaagcaaatgtccagaaggtcggcttggtaatacagccattggcaaccagtccaaagccgccgtggaatggtgtaaaaggaactcccagctcttcaaacacatcaccaaatgtccagtaggaataggattcattcacatctcccaatctggaaagctgctgtgctataaaggccgcattcaggtttgtgtcatgaatgacgccctgaggagtataggagctgttgaactccgtgatatgaatctgcagacccttatattccgggaaactgtcaataatatctctggttgtttttaaattggcaaagccgtcctctgcattcatcagttcagaatatgcataatgtccaatatattccggcggatcaacggtgtaatgatgtctggttacgaaatccacaggtatgtgattctcatggcaatattccataaatgcctgaatccatttctcatccgttcctccacaaacagcagggcctcctacacggaatcccggattcacttcctttatggcatcaaaggttctatggaacagcttaaaatattcctgcatatccgcattttcccagaagccgcaaagattgggctcgttccatacttcaatgggccattgaataacttcctcttctccatagcgtcccatcagatgccgcagcaatgaacgcaccatattacaccatatatcataatcttttggaggagtggtatttccctgccagtaaaagatagtctggcttccatttgccaactttttaggcataaaacccagttcaagaaaaggtctcagccccaccttcttataggcatccattactctatccagataagtatagttgtactcgacccttaccttaccatcctcctcataggtctgaaagattgccatatcatcacagaataatccatgtccccggatatgcttaaatccgatttccttttgaaccaagcgcagctcctcctgatattcttctgtcaatgcaagccccattcttccggttcccacacaataatctacattattgtgaaaaaaggcctttgaatcctttgtaatcacgatcttttttctgtcatgctctgttgccccaccaaaatttaccatgcatgtatctccttcttctaaatcatgttcctatgcagtcacgcatcagatgtctgaccgctgcacgatccgcagctctctgatgacgattgccatattaatatgatactatcgcattgatttaaagttttcaatgatttatactataagaaaattgatatatcctctgatgtatcagaacggagattccagatgactgaaattgaatttgtcggctacagtgccgttcacccctcagattttatatatgatgttccgaatggctttacaggctatcttctgcttcttttcgactctccctcggagctgctcatagacggaagactaatgcggacagccgccaattctgctattctgtatacaccaggaagcaggatttattaccgtgctgccggtgaagaataccggaatgactggattcgttttcgttccgatcactccttcgtgaagctgtttccgttaacaaacaccccatttcccgtaacagatccggaatactgtcatcagctttttaaattactaacctgggagtccgcctttttctcctctgaaagcgaatcaaacattactcacctgcttcgggttctgttctccaaattaagagaaggaatccagaatgagtccccgggtattcacgagcatgagctggttgcattgcataagatgatctacaataatcctcagcttccatggaatataaacatgatggctgcgaagcttcacttaagtcccagtcatcttcagactctctatcaccgcaaatttggctcctcctgcatggacaatgtcatcgaaggacgtctgcgccgtgcaaaggatttattagagtacagcgaatactccatccgcgacatttccgagcaatgtggttataataatgtagagcatttctgcagacagttccgtcagcataacggctgtacccctggacaataccggaaaaatgcatcagcgggaagcaacaaaagacttctcacccacaataccctgggaggaagggagtttgagaagattaatcgaaatcatccggttgcagaatcttttccggttctgtgacgtcttgataccggacatatcgggatgaatcaacagtatattctttcttattaattttaaagttcgggaaggcccattccataagccttctccaaagtgactttttctcctccaacatcatcaatattttctgtaagttcttctccaccggcatacattcttccaagaccgcataaaattttatcagaacatgtataaaaatgacctgtaagtgacattgattcagaaccgtcttgagtacactgtcaaagttgataacaacacatctgagaacctgcagtccgctgaatcccgtatccgtgatactgatatggcagatgagatgacaagattctcgaaagagagcagcaggcagctacttccatgcttgctcaggcagaggatgaataaaatcttctttttcttctttttcccattgcaaatcccacattttcctgtatgatagagatatattaacaataaggaggcatacagttatgttgcagattaaaaatccggttttgccgggatttaatgcagatccatccattatccgtgtggatgatacatattacattgcgaactctacgtttgagtggtttccgggagttcgtctgcatgagtcaaaagatttagtacattggaatcttcttccatccgcattgtccacgacgacattgcttgatatgaaaggaaatccgtcatcgggaggtatctgggcgccggatctttcctatgcagatggaaaattctggttgatttatacggatgtaaaagtaaccgaaggaccgttcaaagatatgatcaattatctgacgacggcagaagatatccgcggaccatggtcggatccgatccgtgtcaatggtgtgggatttgacgcatcgttgttccatgatgatgacggacgcaaataccttgttcagcagacatgggatcatcgcgaataccaccatgcttttgacggtattacagtgacagaatttgacacagagacaatgaaattaaaaccggagacagcacgtacgatctacgccggaacggacgttaaactggttgagggaccacatttgtataagatcaacggatattattatctgtttgctgcacagggtggaaccgtttggacacatcaggaagtagtagctcgttcaaagacgttagatgcgttgagttttgagacagagcctggcgatccgtttattacaaactttgatacgccggaacttgagatccagaagcagggacatggtgctctcgtagagactcccggcggtgagtggtattatgcaagtttgtgtggaagaccgtggcaccacgaaaatgaaagttcgatcgacccacgcggctggtgtccgcttggccgtgagacggcaattcagaaagtatactgggatgaagaaggctggcctcgtatcgagggcggacatggcggaaaagtgcttgtggatgcgccgaaagatgcaatcttgacagaagcaccggcagatcattcgatgcatgatgaatttgacacaccaaaacttcatgatgagtggaataccctccgcgtaccatttaccgaggaaatgggtacgacaggggatggcaggctgacattggtcggaaaaggatccctctgcaataagcatgagctttcgttggtggcaaaacgctggcaggcatttaactttgatgccgaagtgaaagtgaaatttgatccgttcaactatcagcagatggctggattgacaaatttttacaatgataagcactggtcattcgctttcgttacgtggaatgagaaaaatggccgcgtgatcgaagtggcagagtgcaatcgtggcggatatcgttcgttccttcgcgacgatgcgattccggtaccggatgatgttgaatttgtatggcttcgcacaaaagtaagaaagcagtcttacagctacgagtattcctttgacggaaagaactatacagagattccgggcacactggatgctgctgtattgtccgatgattacgtactccagtcatacggtggattcttcaccggagcatttgtcggcatggcatgcgtggactactccggatacgatcagacagcagaattccgcagttttgactataaagaactggattaatcaatagcaagagccttttttaaaccaggctcaatcagatggctggcgatgccgcagaggattctgggaaaaaggacgaaaagtccgggaaccaggaagacgatgaggcaggcgccggccattgtaaataataagatgaaagtttctttgatgtgaccagccatcaggcgcacggagagcagaagaactgccggaaatgaagcgcgcaggtgtgagatcacggcaaagatataattggcgagaacctagaggacgaggcagattaccatccataaaaagggcggtaaaagattgccgttttttccggtaaagacttgggaaagatctaattcatagtcaaaccgaggcctccttgtgcttagagcatatgaagttttagctttgtcttgtagtttacgaatatccgaaaatcaaaaaagccctttgagaaaaggatttctcctctctcaaagggaaagttggcaaacttgaatttctatttgtgttgccatgtcattacataatctttttctccggtagcctcatctaagccactatgctgaatctcaaattcttctctcttataaaaagatattgcccgtgcgttcttttggtatacgttcaagtacaacttattccttttatcctttgcataattcagcagaattttacctagaccctgcgattgcatttcaccagaaacaaaaatgccctcaacatattcatcatttaaccctagggttaaacttaactactattttttctttgcgatataaaatacataactgtaataatctactactaatctaaaataaagcgattataagctatcctttttcctgtgtttgttttaaagttttcatctatacacttttttatcttttcctgttctttttctttatccataaccgttaaattttcaagcaaatcagcttcccattgtatttgaaaatcaagtccatcaattttagatggagtatgatggttgcctattataaagcatattctatcaatatttttgttatagcctaccttttttaatatttctttcgctacttctggtccttccttttcttgatagacaccatcaatagaaccgtattttttttgtgcttcaaccgcaccaatatcatgtagtatagcaataatactgatgaattctttttcttcctctccgatattttctcctttcattatatcttctgcatttttcaaaactttgagagtatgctctatgccaaaaggaatttctttgaatacttctttcatctctataataattttttctttaaacataaattacctccatttataccttataggtgttttagttctatctatccacttttttgttcgccgatacaatcagcatcatgggacggcgcatttcatcctgcatccccggaatatccatcatgtattccggtggctgcggctccacaatatgatttattataaaaccatttgaaagcagtgtatttagatatgtggtcagtgttctatgatattttgtaaccttttctcccaaaaacacagctgtccgtttgccctcataataataattatccaccggaaaatgcagtatttctcctttttcgttataatgccagtcttgtgttccataggcagtaaaaacaggatctatgttttaccttcccaacttctaattttttacatcatatcccaaaagccttgtcgtactcaataactccatttaatttgtttttacttccgttaagattaagtgccataaaactttcatcgtcaacttcaaatggcgcttttattccacactcacttgccggaatatatcctgcctttggatagtatttggaatgtcccaaaacaactgaatattcatatcccaatttatgtgctatactgtgtccttctttcatcaaagataatccgattcccctgttctgataatcgggtaatacagaaagaggggcaagcgcaagaacctcaaccccttgaacaactgcttttgtaaaaagaatatgtcctacaattttttcgtcctcgacagcaacaagagaaagttccggaataaacgatttgctttttcttaacgcagcaactaagttctgttcatttccatctgtatattcagcattttcaaatgcttcttttacaacatgatataccgtatcataatcttctggtctttcttgtcttataatcaaaatagatacctacatagttttaagctttttacaattacaggaaatggcaaatctactatctacctctcaatttttatggctctgacaatgataatatccgggatttctttattaaaatagcattcttcgtaaaatccatctatgacaaatccggtatcaaaacacagattaaaaatatcctgtaaagaacgatgataataacattgtttttgcggctgtccttcaatcgcaatatcgtaatagctgtgcggcgtcatatatttttctgtaagcgttacaaaacaggggtgctgtgtcgcaaatacaaatactccgttatcctcaagcaatttataaacagaggtaaaaagcggcttaatatcggtaatatccatgaccgccatattggagactgcttttgtaaacggcttatttctttttaatgccatcagacttgtttcattcgtggcgtctgctacacaaaactcaatgtgatcagcataccgtttttggcgcttttttgccagttccaccattttctcactataatcaaaagccaaaacagagacagctttttctgcaagatatgcagaataatttccatttccacaggcaatatctaaaatatagtctgttggatcaggatttagaagctctgttactttggggcggacaacttctctgtgaaaatcatttgattcatcccccattgcacaatcccaaaattcagcgttttgattccagattgctttactttcttcctttgaatactgcataatatcatctttctgcaaaattactttttctccttcgccccatggctcctgaaatgcgtgataatgatgttccaatatttcatctgttatcacaaacggcgaattggcatttaagacctgatttcttttatatagtcttttttgcaaaagctccttactggctttcatatagacaagttccgtttcagcgcctgctttttggatcagctctttataaaaattccgatttctcagtttcaaaaactggaagttataaacatctttgcaaatataccatatctattaactgtacaccacactcataaattgggtggtcataattgtccgtaaagaaattcggaatattgtgagatcggacaaatccgcatttttcataaaacggtacggtcaacgggctgtcacctgttccaacctgcaaaatagaatattcatctgcatatttacttgcaaggaagtcaatcaatgctttcccatagccctgtccttgattctgaggatcaactgcaatatttttaatttcaagtattccattatcttcatcagtaacaacacattcagcttttacattaccatcttcaagtacatacatagtacctttttcaagatagtgatcaatcatattttcctgctcatcagctaataacaataatgctataaattgctttttattctcattcacttctcggattttcatatttattactccgtcaaactgaaagtttctttttcttgataaatggggattagttttccttttttccaatcagcaataaccacctatggtcaaagcatatttgtccctccttgatatagggattaaaacctgttttatctccaccattcaaatcgtattccattttatcaataatatctttttgaatatcctctggtgtacttgtcaaatccatccaactttgtagatttacaggaacaagtgttgtttcttcaagctgaagctcaaaagcatcctcaaacaatgcttcaaattcttctctgctaagtattcttgtatgtgagttatcacgcatcgtttcaatagcgtcattagtttcacgcaattcttctgtagtcgctaccatatcccaaataacaagttttccaccttttttcaaaactcgttgcatctcccgaaaaggcttttcaggctcaacaaaatggtgcaatgaaagtcttgtaatcacaaggtcaaatgtttcatcttcaaaaggtaagcattccgcattccccgatacaaatgatatgttctgaataccttcttgctttgccagtttttttccctgctccaacattgcttctgtcaaatccaaacaagtaatgtccttaacataaggagccactgctcttccacatatacaggttccagcagcaacctccaatgcatgttcattgccctttgcctgaatactacgaatcaaataatcggtatattctgccttagacatatgatatgaagcaaatttctctgcttgtgtaccaaatgattttttcacttcattatagttattcataaacttttacctcgctgtaaacttcaaagtttctgttccttacaaacttgaatttgacttgcctattttcttaaaatctcatgtggagcttctatttcatttgccaaggtatgctctgttaattctgacatcaatttcaattttttattaatcaatggtcgcatacaattaggaacatgttcctgatgcgctctgtggattgctacacattccttacagtttccgtgataacgacaggctttcaggcaaggacagtgatctttgtctttatactccttacgaaattccgctgcaaattcttcttgcagtctcagcccctcgacacggtttcccttatgaaattctaccattgcatccagttctttctggttcccttcaatcttcatgttattatagcgcctccatttcaactattcctcattttctgataaattagaattttcaaattagtctttgcaaataacctttgaaccttcaccatcaattacaattccctgacggttgttaatcgggcatagattcaaatccgaaaactcagtcattattttctcggtaactttcttaaatggtgctgtaagataatgcggaagaacatagaaatcaatcaaatcaagccctgcatcatcttcttgtgagtagtcctctggcttttcatccatttgctcgatatattggatgcttggagcgcatataattgcgcctgccgactcgccgatcatcaattttccatttgccaattcctttttcagtagcccatcagttcccgttttacggagctggtccataagaaagaaagaatttccgccggtaaaatatatcacatctgcttcttcaaaaacagactgtatcgttgaataagcctccgttgaaatatcaatttcagttacgattgctcccaactttttgaataattttcgagccgagccggcataaccggtgtagccttcacgcagtgaagctgttggaataaatgcgactttcttattttcaatttcttcctttatcagacttcccacacttgaaaagtgcgaacataaaaatagtttcatcaatattctcctttataaattccgatttgcacatcaaatcgttttcttcattctatcacaacttctattgatccgccatcagtctttcgaaccaggtatccatgacaatgataaactggcctgttcctggcaattcttgcagcatttcatcaagagttttctgtttcacatatttctgcacatacacccaacaggcaacgctactggcttctgatacaatgtcagctatggttttgcgcataagctcttcaaattcagcaatttcttcttttggaacaacatcatacagggttggtgcctgatccgttctctgtgaagattgaaatctaccatacttaaaatggaatacagaattctttttctgtatttcggtataaatactatgtgatactggcatttccatcgggtatgtgataaacttctattgtccatttggaccgcctcctttgattttgagtttggcttgcgacaccattctcatcatatcacaggaggctttattttgttgtcctcaccgtctccacttattccattctccccagcatagctgggggattagacttttcattaaggagaaggataccaagtgggcagtgggcaatacggtggattattcatcgtttacggtggttgtttgctcagttttttggaatatagatgattttgtcacaggcgtaaagttcttctcccccgctgtttcgcatttcatatccgatatatttacaattcccatccaactgactataataaagaatgtccgtttgcctgcaaaggcgcggaaccatatccatctgcatcagggcgatatgacagaaaaatgaacttaaaagaatggaagaaagaacaatggatgtaattgaaaaatttggaaatagggtgagcagccaggcgcttaaggatccagaaaaagcgcgtcggctgcttcttgcgggataccgcctgcaggaaaagaagcttcagtttttgccggatcgggggctaccgtcgtcgggacagtatgtggcgcgggtggttatgaaaaatatcattcagtcgctgtcggaaccggagaatgcggcgatggtcagcatatttgtgccgggagagctggtgatggcggcagggctgacgccgtactcagtggaggcgatgtcctgttttatggcgggaacaaagtgtgagcagacgtttcttcggaaaacggaggaagaaggatttccggagacgatgtgttcgtaccacagggtgtttctgggggcggcgctgacggggattctgccaaaaccgaactgcatgatttatacgaaccttgcgtgtgatggaaatatgatgacgtttccgtatttaaaggataaatttgaatgtccaggcttttatattgatgttccgtatgagaaaaaccgggaatcggttctgtatgtggcggatcagctacggaaattaaaacggtttctggaggagacgacggacagacggatttcggaggaaacagtgcggagtgcggtagataacagccgaaaagcggcagcgaattataaaaaacagcttgccctgcggtgtgcgcatgacccggtgacctctctgacgaatgaattgtatgcgctttttatgtgccatctgatggctggctcagagacggcggttacctatacggaaaaacttctgcgcgatgtgcggatgtcaccgaggggagatggtctttcggtaatctggatgcacatcatgccatttttacaggagccggttaaggatatttttaattatagtaagaaaatgcacatccgcgcttgtgatttcatcgcagatggttttcaggagatgcatgcggaagacccgtatgaggcgatggcagagaaaatggtctactgcatttacaatggcagtgtgaaacagagaattgaggaagcggaacggcttgccagaatcacggaatcggatggtgctgttttatttgcccactggggctgtaagggaacgatcggtgcatccagcctgattaagcagtccttagaaaagacaggccttccgacgatgattctcgacggtgacggctgcaaccccgccaataccagcgacggtcaggtatcgacgcggcttcaggcgtttgtggaaatgctggaaaagggcaaggaggagaaacacgcatgatttattacgtctgtaagtacaccccgatcgagctgttccgggggtttggagaagaatgttctgttttggaggaaatgccggaaaatttcgaacagtcggatcaaattgcacatgcaaatctgtgcggctttggaaaatcggtcattcaggcagtgctggaaggaaaggttgaacagctggtgctggtaaactgctgcgattcgatgcggcgcgtttacgatatcgtggagagcacgggaaaatgtaagtttttatatatgctggatctgccgcatgatgataatgaatgtgaaaaagtgaaatttgcgggcacgatccggaggcttaaaaaggcatatgaggcatattccgggaaagtgtttgataaacgcgcttttatcaagtcctttattacgccggaaatgaacacggagccgtacattggtgtgctgggcgtgcgggtcagcggcattctggaggatatgatccgggacaatatccagatggatgtggaaaatctgacctgtacgggtggtcggaaactgtcggtcgtacaggatgaaatgtggaatatggaggaagaggagctgtttctttcttacgcggacgtcctgctgggacagatgccgtgtttccgcatgaaccgttcgatccgcagaaaccgtctgtatctggatccgaatttaaagggaattatttatcacacgatcaagttctgtgattattatggatttgagtatgcgagtatcaagcgggatatcaaggttccgctccttaagattgagactgattttacgagccagagcgcggggcagcttttgacgcgcattcaggcatttgaggagacgatcgagggatcagaggatatggatccgggaaaaggtatcagtgaggaggcaagaaagaagatggagtcaggcattttttatgtagcgggaatcgacagcggttcgacaagtactgatgtggtcatactggatcaggatggaaaaattaaatcgacgatgattattccgaccggcggcggtgcgatgatgagcgccgagaagagtttggatctggcgattgagaaagcgggaattaagaaagaggagatcgtgcggatcaatacgaccggatatggacgatcctacattgacagcggggatgacagcatcacggagattacctgccatgccaagggcgcaaattatctgaatccgaatgtccgcactatcatcgacattggcgggcaggatatcaaggcgatcagcatcgacgggcagggagccgtgaaaaatttcctgatgaatgacaaatgtgccgccggaacgggacgttttctggaaatgatggcgaaaacgctgggactttccctggaggaaatgagtgtgaaagggctggaatggaagcataatgtcgtgatttccagcatgtgtacggtgtttgcagagtcggaggtcgtgtcgctggtggcacagaataaggatgtggcagatattatccacggtttaaatgtgtcagttgcctcaaaagtcggcgcgttggcagcccgccttggaaaggatcatccaggcgaatatatgatgaccggcggtgtggcgaagaaccggggtatcatccaggcattggaagagaagcttggtgctaaactttacatctgtgatgaggcgcagctctgcggtgcgctgggagcggcgctatttgcttatgagaaatgtaaaggcagtgcggaggaaacgcgatgaagcgacagggttaaaacacttgtatcgatattttcgtcagatattcactgggagaggctgtggccaattcgtcgatcacagcctctttataagagtatttgccggttttaaacttgtgttcatcggtccaatcaaagagtttttcgtaggtgactttcgagtcatagtaatttcccattaagtaagcaagtaccttgccagcccaaagtgctacaacagtcgccctcaacagcatatccaatatgcgcaaagaagaagtattgcaatatagaactacaaccttcctcttccatatttttttaatatctgacacatttttacggattgcattttttacacggatcataacctgcagcaatcagcgcatcactactctctgatgaggattttttattgctctccttcatctgtttgaccgatgaacaggacggccgatgaaatttctttgtattggtattgaggatataggattccgtgctggtctgctgagaagctacctgcgtaacagcctgtgtggcctgctctgttactgccttcaaaaaccggagtcacccgatacagcacatgatttccagtttcttttacatagtccgctgccatattctcaaacggcagcattccctgaacattcagatatctggtcccagtgattaagttcttctcgtttgcattttctgcagtaagctgataaccgatcaaatggcagcgattatataaatatttgccatccacattgtcatatttgatcgtatgccaaccagatggctttctctgacatttctttatcctcttttctttgaaatatgaaagaaaaattatcccttcatataacgaaacgctcagagcatgttttacagtggtcaaaagcaaatttttttactttttttcttacgagttttcttgcgtgttttttaaataccactcgtaagaaactcgtaacattagatttttcagtaaagaaaaagagcatatggaattgaatccatacactctatgattactgaaactttatttcatttttaattcaacaaacttttgtttatctcgttcttaacttcatctttattctcgtatgttctcactatcggaatcgtactctgtctgttctacataatctgcggaacagtctcgtttgtacggataaaaaattcaagtcgagcatccgcgagacttggcgcgtgattctgggcagcgtaagctgacatattctttacagaatcactgcgcatcctcgcggagcgtttatctcagtcgagaagactcccactgagacaaatttgctgttactcaccacctgaaagaggtgggagtcttctcgactgagataaactgagccacggctgttccaacatgaaatcagccgtggccttatttatatcatttcactcttttttgaaatagaacaacaccacagcaacaactcaaatcgttttaaaattccagactattcgcattcagcaagaaatacttcattcccatgatgacaaaaccttcatcatttctccaaggctttttgctgccatttacaatgacgatcttcttgaaagagtccgggatattacgcagagaattgaactcctgcgtctgtttttcttccgaagtcatgtcatatgcaacctggatatagtatctctggtttccttgattcaccacaaagtcaacctccaactgcttgcgaacacgtttgccctctttatccttatcgaagatatccacgacacccacatcaacattgtagccacggatcagcaactcgttataaacaatgttctccatgatatgagtaggctcctgctgtctgaaattcagacgtgcatttctcagtcccagatcagtaaagtagtatttcagatttgcaccgatatactttctgcccttaatatcgtatcggcttgccttggaaatcaaaaaggcatctgtcaaatggtcgatatgcttggagatggttttattagcataagtcatctggcgctcactggcaaatgtattggcaatctttgaagggttagtcggtgcgccgattgcagatgcaagcacatcaaccagaatcccaatctcatccacgttctgaatcttatttctttcaataacatccttcagatagacatttgcaaagatgttcttcagatagtccgctttctgtcgttcgctctggaaacttacgatctgcggcaatcctccgtagatcatgtagtcatcccaggcatcatcataatcgccgtcatagacagaataaaactctgcaaaggagagaggatagattctaatctcatcacctctgccacggaattcggtcacaatgtcgctggaaaggaacttggaattacttccggtgacatacacatcaatattgctcatgcggagcaggctgttcagcacttcctcaaatcgtggcatgaactgcacttcatccaaaaggagataatacttcccgtcgtctttcatggcatccttgatgtacttgaagcataccttgggatctcttaattcctcgttctcaataccatccaatgcaatttcaataatatgatcaacatcaacgccgttctccagtaagtatctcttaaagatggtaaacagcaaaaaggatttgccacatctacgaatgccggtaatcacctttatcattccattatcttttcgctcgatcagctgctgtaggtaagcgtctcttttaatctccatcgttacactccccatttccgtgcatttacacactttttagtaatgaaattctatcacagaacgacctgaatttcaatatgtattcccattttatgtgcatctacacacttttatgtaatgttgataaatatattttcagatttttttgattgcagtgtctataatcgattactccaatcgttattataggtaaacaacaaaaagaagatggttccgatgtttcattaaatatgttcgttagtcttttacgcaaaggattttatctcctctgcgccctaatgcttttcggattcagttcaacaaacttgaatttgacttgcctattttcttaaaatctcatgtggagcttctatttcatttgccaaggtatgctctgttaattctgacatcaatttcaattttttattaatcaatggtcgcatacaattaggaacatgttcctgatgcgctctgtggattgctacacattccttacagtttccgtgataacgacaggctttcaggcaaggacagtgatctttgtctttatactccttacgaaattccgctgcaaattcttcttgcagtctcagcccctcgacacggtttcccttatgaaattctaccattgcatccagttctttctggttcccttcaatcttcatgttattatagcgcctccatttcaactattcctcattttctgataaattcccatacaaactggaatttggtgtgtgctttataaattttttccgatccactcaagttcgttcatggaatccttatttttttcaagttcatctctggctgttgcgtaatatgattttttgaaaagcatatcccatgaaagatattttgccatacagtcaaactgcttatcaatcagctcatactggatactgtctacgggagaaccacctacaacaattgtgccaacttttttgttttttaactgcaatccacggcagtagcacttatcaatgataagtttcaattgtgctgacattccccaccaataaactggtgtagcaaaaagaatcatatctgcggcagcaattttatcaattgtagaatttgtatcatccttatcgacgcatcccttagagcattgacagacaccacatcccttgcatggtgcaatgttgagtttgtcgggttcaatgatttcaattttattcttttctgacgctccttttataaatgcattgattgctgccagcgtatttccttttctggcacttccattaatgattacaattttcatgcgtgtatcctccaacttccgatttgcacatcaaatcgttttcttcattctatcacaacttctattaatccgccatcagtctttcgaaccgggtatccatgacaatgataaactggcctgctcctggcaattcttgcagcatttcatcaagagttttctgtttcacatatttctgcacatacacccaacaggcaacgctactggcttctgatacaatgtcagctatagttttgcgcataagctcttcaaattcagcaatttcttcttttggaacaacatcatacagggttggtgcctgattcgttctctgtgaagattggaatctaccatacttaaaatggaatcatcttcacttaatactcggatgatcaccggtactttacggtatcctagtttctccgcagcatgttttcttctgtggccggatatgatctcatagtagccatccggtactggtctgacgatcagcggatttaatatgccatacttctcaataatttcctacagaagaaacatttccttatcatcttttacttgaaatggatgttccttaaaatggtggagacgttcaatctcaatttctatgattccttcttcgttttctcctgattgtctgtttggctcagtcatcttgactcctttcctccaggattcaggatactaaaaaatgcctgcctggaacttttatagatagtaaagttccaaacagacattgctgtttgaccattagctgcagctaatagaattaaatactgtttcagctaatttatgtttgcaggtttgggagagattgtttcttttcccgccttttctctgatttacatccccgaataaggggtgacaacagagcagaacccaaatgttagctgaacttcctaaagcccatgtttgcaaacaggtgattttgattagctgtcagctaacaaaaatcggattgcgttagctggaaattgatcattttgaatggaattttgtgtcacgaacgtgattagaaaataacaaaagcgttcgctgtcagctaatccagctaacattttcgaacgctttgaagcccgtcgccaagaggatttgaacctccgacccctcgcttaggagttcatcctggtacagaaaacagcttgcattctatgtcaatcaaagtcattcaaagccttgattttactgctttttctgtcaatttcagaaaagataagaaaacctgttttcatctgaggaattacagtttgggtggaaaaatggtggattttccaccattagggtaaagccaacctgttccttccaattataaatgatgactaccattacctgacattttacagtaatgattatttggttttcttattagatctatgtctattataccgtgcttgcggtcaactgtcgataacaaattgaccgcaaatgtattattttttcttacgtttacactttgtatcacaaaacttctacacttcaaatactcggaagtgtttctgagcagattcatatttccctgtttcgtaatttagtattttccataccggatttaattgctcgtccgttaacggagtaacctgattgtctttatccagccatgcaaaaattatctgttctgattctatccaggttaagtttttatccttctttatctcatcaatattctcctaaatatttttctagtcattgcaatataaaattgcttatacagtctctcccttaagagtcctggtattctggataatatacagagcgaccgatatgaccatcattatagcgcacaaaccaatcaacagatctgataccatcggtgtaatgtggaaccatataatatgcaccgctgcagttccatataataaaaaggttactatctttccatgccagtctgcaccatgtacttttcctgtcttttgtatcacaagacatccactgactatcatatacagctccttacctgccattattacgattaaaagaagcacatgcggaaaacgagtaaacagacagattaacatcgctgcctgtgtcagcttatcagccaccggatcaagtatttttcctaaattactaattctatggaatcttcttgcgatatatccatcagcaagatccgtaagaccagacagcaataagatttcaccagctaacagaggatttttctttacacaataactccatataattaccggaatcagacaaagccgaaaaaaagaaagaagattaggaaccgtaataattctattcaaattttcttcctgattcacttcactctgcatgtacggtcacctcactttccttttttttagacataaaccaataaaatataacacaaaatgctaaagcaaacacaacaccaaaaacattttgaatcactctaagactaaccgctccttgtagtccataagtctctgcagcaatggctaaagcaccaaatgtgttaaatactgcctgccagccatattgtgctgaaaatcctacaccgattccaccaagaattcctatatatgcatagattgacgaaggaagcagaaaatataatactgtaaaacatataacacctgcaatatttccgacaatccttttacggactctgtagtgcatatcttccataaacggcaaaatcgcggacatggccgcaataccagcccacattgcacgtggcatattacaaagttctgcaatgcaaaggacaatcggtacgcataaaatctgacatatctgccattttgttctggaagaagtgatatcaaattcttgtatcagatctttcagatttcttttataagttctgtttttatgatttcgataaaatacaaagcaggtaagtgctgcacctaaagccattccgactaatcgcatctgatagctttttcccgtaacatcataaccatatagcagcagatacccaagaaccaatgtagattgattaaacatgaatggattatggcatccgaacagaatcaacacagccagtgccgcaatatttaacagcattcccaatactggtgaaaactgatttgctaaatgcggacatacagtcataattacaaagaacaaagccaaaagcatcgtagattgtccggtgtggatccccagatccgcattccgaaataccataaggcataataaaactactacacccacaatactattctcatttccaaataagatactgaaaatagtaacaaataaaaaacaaaatgccattgtaacagctatctttaccaaatataccagtatatgatatgatttttctttcactgtttcactctttttcaacagatttttagaacctgcctgatttaactgcaattcctgataaaatgtcatgtaattcctcctctatctgtttttcttaaacttatatggcctcatctttctgtattggaagctctacaacaaatctgcatccaccatattcccggttttctgccttgattgtcccgccagcactatctacgatccgtttcacaagtgcaaggccgagaccatttccttctgctttgtgagaaccgtctgcctgataaaatttatcaaatattctggttttcacatcatcctctattcccggtccttcatcttccagaataaacattacagaatccttttcctgcttcagaaacatcataattgtcccctttgcaggactgaacttaatcgcattatctaaaagattcatccatatatgcataaaaagtccttcattcccagtatatttaacttcctccagctctacctggaaaccaatttctttttctgtccattttgtttccaatgaaagaaatgcctggcggatctgttcatccagacgatattctgtttttttcattggtatattctgattctctaacttggataacagcaaaatattaccaaccaatccggaaagtctttgggtgttaaataagattttttctacatattcctcttgatccggagacagttcttctccctgaagcagcattgtatatccttcaatggcattaatcggggtcttaaactcatgagaaacattagatacaaaatccatctgcagcacctctgttgcacgaagttcttttgtcataacgttaaaactttgataagattctccaacttctgctatacggctgttcgtttccaaatgctgttcaaaatctccctgagaaacttccttcattgctttactaagtctggtaattggttccagtaactttgcattgataaaggaagtgatcagccctgcaatcaatgtattgaaaatcaaaagccagccaagcacaggtatgccgcccggcagattaaaaaaatgattcaaaaaagcaaataataaagcagataggactgttgaaaatacaagtgccagccagattgcaccagtcagacaggatcggatccgcaatcctttttttttcttttgttccattatctttttaccaccttgtatccaattccacgcattgttacgatttcaaaatccgggttatctttaaaacgctctctgattcttcctatatgtacctctattgtatgtgggtctacctccgtctcgtatccccatacttcatccatcaactgttgttttgtaaatgttctgcctggcgaagctgcaagcttatataaaagcaggaattcttttttaggcaaaacaagactttccttatcagttgtaaccgtcattgcatcataatcaaactctgttgaaccgatcacaattttgtgttcattcagtatctgtgcacggcgaagcagtgctccgactcttaaaaccatttcattcacatttaccggttttaccatataatcgtcacttcccgaaagaaatccctggcgcatatcatcaaaggaacctttcgcagtgatcataagcactggtatctgatatcctgctgaacgaagttctgacaccagttcatagccatccataaccggcatcataatatcagaaatgatcagatcaatatattccttatccaatacttctaatgcctgtgctccatccgatgcatttttgacttgatatccattcttctcaagcactttttggaatagctggcttaattctttatcatcttctacaatcaatatttgaaacacgttttccttcctccttattaaaacagataccttgcccatccaagcagatgctgtaccaaaaatatttttctctgacgtttctttgttaattcaattggctctacatgatatggatcattataagttccgccttctaatatctggcgggacactttttcatattccatcatgccctcttccaactgtttattaatatctttactgcgaattacaagcatcagttccgtatccagatacgtgcttctcatatccatgttaaaggaaccgattacggatagatcatcatcaatcaggatgctttttccgtggtaagaatagccgccttcatactcccagatatcaattcctgtatttaaaattctgtttctgtttctcgcataatcagcagaaccaaacggatttccattgttggcaaccgaattggtcatgatagaaaaatccggaactctctccgcaatctctttccatgtattatacatcatatcattgcagataatatatggtgtatgaattttcacgcgctcttttgcatttttcattagttctcccagttgataccagactactggttccttgggatctgtgtgaataggatttgacactaatgtaatcttttctgtctcaaaagtttcgtccgtataatcggtctcgcagattctttccttattctcttcaaaatatttctgatagccgttctgcagctctaaaactgcgttctttacagattttctatttgccagttttttattgttatgaaaataaccactgtcttcctgattccatatggtttcaaaatactctgacaactgattaactgaattttccttctcaggttcatcgcaaaccactaacacgtctctgtcatagttcttatgtcccggaaaatcacccaggaaataattgtatgtatttcttcccccaagaatatatctctttccatctgcaatcaaatatttatcatgcattctacccatcattttccacggtttcaacggattggccttattatacagtttaatttcaacattctcatgggaagataatccatagaaatacggatttccttccatatcaatccagctctccattccatctactaacagacgaatatgtacacctctgtctgccgcatcatgcagtgctcctaaaatcaattttccactttcatcggattgaaatgcaaaagtagaaagaataatgtcttcttttgcatttcggatcaaacgcactctttgtaaaagtgcttctggatttttttctatgatcactgctcgttccatattctcactgcattcgttccatgacccattttttgtttcttttttggttgtattggacacttccggctgctttttatatgcaacgcagattccgagcaattcataaaaagccacacataaaaaaattgccagtataacaagaaggattttacatattttatgctttttcattgtacatcaccggattcctttttatttcatacttatacaatacaaagtcaatctcaatttaacctcaacaaggtttgtttttttcatccatgcaaaatcttctttgtacaacagactgttagatatagcaaaaacggcctttcaaaaacagttaacttctaaatcaactgttttttgaaaggtcgtttcatcagattcttatagcaatccagcaaataatctcataaataattgtcccagtcgcaaatatgcacttcgtccggtttgatattggtctgtcacatcacgacattcttccatcgttcttatcaaatcattttttatttccacaactgcctgacaatctgccataaaacagccgttttcaaaatggtgatataaacttcgataatccagattaattgttccacaagttgccatacagtcatctgccacactcatttttgcatgacagaaaccaggagtccactcataaacacgaacaccatgtttaactaatccatgataaaaagaacgagttatattataaatgaattttttatcagggataccaggtgtgataattcttacgtctacccctcgcttagcagccagacataacgcatgcgtcatttcatctgttatgattagatatggagtcataaaccaacaatatttttcagctttatttatcatactgatataaacttcttctcctacttgctcattatccatagggctgtctgcataaggttgaacaaacccagtttgctgtgccgcataatcatagtggaaaaggtatttactaaaatcagaatcattagcatccttatcacttactgcattccacatttccaagaatgtcaccgtaagcgactgaacagcatctccttctaaacgaatacctgtatctttccactgtccatacgggtgtgtgtaattaaaatattcgtttgctagattatatccacctgtaaatccgacttttccatcaataactgttatttttctatgatcacgattgttcaaaaacagatttaaacctggcataaacggattgaatacacggcaatgaattcctattgcctccatctttttcacaaaatctgtgttaataaagcctatagaacccatatcatcgtagaatactctaacttccacacctgcttttactcgctcttccagaacatcttgaatcttatgccatgcttcagcgtcttctatcgcatgatattccataaagataaacttctgtgctttctccaaatccttaagctgtgcctctaatcctttcactgcttcatcaaaatacacaatatccgtattctgatagattggatactgcgaatttctttgtatgtaacttgctatatttcctgctttcggaattgtttcttttattttgctcaaacacgcctgactgtctggaagcattggtaacaatttgctatcaatttctgcatatctctcacgcattttatgtgtgccaccattcaaaccaatcaacaaatacaggcctacacccataattgggaagattagaattaagatgacccaaggcattttcatagaagaggtcttatctgatgcgtacaatcccaaaaccaagattccactcaaaatccttgtaaataaatttataatttctgcatattcattcaagcgtgttacgatagtaataataaaaattacttccagaagaatgcagactatggaaaaacacagccgttttaccccattttttgtttttgctttgccctctaaagtatcttgcttcatatatattccaccttcctacttgctcagttttctgcctaaatttcatgaaacataccaattttgtcttttattctctgcatttcatcatccgcttcaatgatagctcttgcagaatgaagtaattcttcacttatctcatcataaccaggcatttcttcaattccttttttatagcgaagttgatgttccaatgttgcccagaaatccataccattggttcggatctgtaattctacacgcataggtgttttacccttagcaaaaaatactggtatttcaacaatcatatgatagcttcgataaccatttggttttggattttttatataatcttttatttcaataactttaatatcatcctgttgggtaatcaaatctgatatcatataaatatcgtcaataaacgcacaaactattcgaacgcctgctacatcatttaaatatgtctgtatattttctgttgtaaaatcatgtcccattttctgcaatttattgtaaatactattgggcttcttaatccttgtttttataaaagaaataggatttcgattgttctcaactgaaaattcatcatccaaaacctcaagtttagtttgtatctcccgaatagcacaacgatacatcatcattaaattataaaattttgtagcattatttaaaaactgtagtgattccggactgttcatcctgagtttttttacttcatcttttgtcatggaactttcctttctacctcatccctgatttcaaaacattatttattttgatagttgattcgttctccttgaattactggataacaaatcattttatcactatccagattttctacatgcatatctactgcactgatctgatggttttcataagtattgtaataataaataccttttgtaacattacaacacgacgtatacaatgtgatttcatattttccatccgttacttcgcaacatcctcgttgctgatccacagatccgagaatgtggaagaattggctaacgctttcttcctctgattcacctgaaattgcatttacctttgtaaaagctacacgtacaaagcgtgaggaagatgagagatctcccggaagacctaatcctcccatacctctactatatgcatcaagagccaaattttcgcagaaagtatttctgggctgtttaggagataaatacatataattatttagttgaaacatctgctgtggaaatggcggattattcgtaagcactcctactggattgtcataaatatgcaaaccatctgacatagattctaccgtaattgactcattctcatcagaaatgatccagtgtaattgtgctaatggcaattgctcgctgaaaggagtattaacaatattaattcgttcaagaagctcgcgaacttcaactaaagaagaacactgacttaaaatccacggaataaattcaaactgtgcaatattttccacatctggcttaatcgttgcataaacagcatttcctacaaaattcagtcctgccattgccactcctttttcattcatagcatcataatacaaaggataatcctctgcaacatgagccattccaataattgcataatgatttttcatatcgccaacatggcgaaaattaaacgcataattacgtggtgtaattactatctgatcaccataagagaattcataatcgagggttcgtccaaagtaaaaatcttttgttttataagttgctgctgtacacatgatcgtttatcctcctaaacagattgaaatatgtcaatgagttttttcttgaacaatagtatagcacaatcttttattttgttccaacttcatacatgatcataacatgtaaactttaaactattttcctagattatttctccatcagtttttcaaaccaggtatccatagctaggatgaattgacctacgtctggcaattcttgcagcatttcgtttagggttttgtgcttcacatatttctgcacatacacccaacaggcaacgctactggcttctgatacaatgtcagctatggttttgcgcataagctcttcaaattcagcaatttcttcttttgggacaacatcatacagtgttggtgcctgatgacttatttttactccattttcatttgcatctttaagcagattcttaactttttctcttgaatcctccggtactttcatgtactcccacataaatgctaccacatcggctggtgtgtcttttttaagtggcggtagctgaatataatcattgtttttgctcattttcatattctcctcacgatataataaaatcaataatacgttctcttgtcatgtccaggacagtatccacaagcactcctgcaaacaggatcagatacagaattgcactcagcacaaacaggaatgcaacctgtacccagtcatggtaacagtatgcagtcgctataatcaacaaagtgaatgtaaacccaaggattcctctgacaaccgcataagtctgtactgtcatcttcactgccaggccaatcacaaaaaggatcagccataccggcagtaataatatcttcccagcaagttttaaaataaacatgtgcacctcctatcttaccagtcctggcatatcatggttcacctctgcctgataatacccgttcatcgttgacggtgcattaaacaaagctgctaataaatatttcttgatgttcttcacctttgtggtgttaccactcatacagtgtaagacatactcgatatgtgaataggtcagcatcagaaattttttcttcaccagtgatgccggataccagttgctggcaatcaagatcttgtcatttttacacatcacagtttctacgatcaggttcacgatttcatcaacctgtcgcatatcgtcatgatgggttacttccagtgactcataatcaacggtctctttgacaaggttttcataagcctgataatcctcagaacgattatcgctatcaaatcttttctcatccacagatatgatatgattagatttattatcattcatttcagtatcactaagattagtattattagggtttgaaatgtaaacttcttgaagtttgttttcgggacttcatgaagtttgaattgtaaacttctgcgggttcctcattttccacagaagtttgttttttaaacttctttaattcctcttcaaattttttctcatctgttttctcaggcataaaggttttcacgtagatgacgttcacctttccaaatccctgtctgcgtttctcaatcaggccaatccctgtttcgtcatccagttctctcatggatttgatggctttatttctgccacagttcagtaattccatgatatcttcgatggaaaagtagatatatgctctgtttttgtcgtcaaaccactgattcttgatggaaagagacattcgatccaacatcagtccatataaaattttagcatcgcttgataagtctttaaagtaactgtctgtaaataatgcttttggtatgcggtagaagctgaactgatcagcttcggtaccgtaaaaataattaaatgtcatttttttctccataactgcctcctttcgttttctgctaagaagtcctctttttaaacttctttgactttgttttcttaactttttctatccttaacaggactgttcatgcatccatttttctaataatgattcaatcacctgctccatatctttgtctgtataatcatccggaaagtactttgtcagtttcttttctgagaaagtgagagaccgggatactttctttgccatcacacagttattgaaaattgataacatctgaatctgattgattggcccatcattcagttgatttctaagtgttgcaatctgtttgggcttgataaatccagtgtcgctgatatattcgtaaatccattcctgtacttccttatcgatataggagatatcaacagcaaccgtgaactgaagctttttgttatctaccagatcaagcagttccggaattaactctgtcaggcggataaatctttttacctgatgaccacttattccctccgtttcaccaattatatctgtggttaaattcgggacaatttgtcccgtatttcctttactgggtctaccagcttttcttttcattgcctcaagtttcatcttataagcaaaggctttctcactcggcaacaattcctctcgctgaatgttagcgtccaccatagccacaatggcatcatcatctgataattctcttacgattgccggaattgtcgtcagtcctgcaagctgtgctgcatgcattcttctgtgaccggataccatttcatattcttcattttcatccatgcgaagcagtaccggtgtcagcacaccattgatctttacactttcaaccaggtcctgcatcttttcatcatccagcaccttgaagggatgatttttaaacggatggatcttactgatctctatctccattgctgactcttcatttaccacaccaagcagttcatcaatacttgccagtttaatcttttcgccacttctatttttcattcttcaaaacctcctgtgttaagttcatatatgcttctgcaacctttcctttcgggcagtgcatgtagatgctttttccctctgcactggtctcagcagcttttacagacatcggaattacattttcaaatacctcgatctgacttccgtaggttgtatgtactcttgatgcaatgtcccttgcgtaattggttctgaagtcaaccatagtcaacagaatgccttcaatcgccagtttccggttcagtcttttctttactgtaagaatggtcttgatcagctgctgaagtcctttcaccggcagatatgcggcttgcacaggtatcagcacggaatcggaagagaccagtgcattgattgtcatcataccaaggctcggcatacagtcaatcaggatataatcgtatcggcatcttatcgcatcgatatattctttcatgatcatttctctgctcataacatttcccatcgttacttccagtgcggaaagctcaatatttgccgggagaagatctacattttcctggtgatgtaagatcccatcttccaaagagatttcttcttcgttgatgacatccatcatgatcgttgccagtgtgatgcgaagatcatccggttcctcatatccaagacttgcggttaaacttccctgtggatccgcgtcgatcagcaacactttcttaccttctcttgccagtccaatgcctacatttacggttgtggtggtctttccgacgccacctttctggtttactacggatataactttacacatgattgcttcctcctttaactttcccatgattcttttttccataattttagtagtgtcaatatttcccgtttcatcattgccggtgtataggaattcggaaaatacttatgtagctgttcgtttgtgaaagccactcttgtgatttcaccctttttaacctcacacatgatttcttccatcttttccagtgacaactgcttttctttactcagttgccggatcctctgggcctgtgagagtgacgggattgcctgtgcatactccattgctacaagcagttccttttgctctttttcacttaatgcagctatctctacagccggacaaaaagaaataatctcatcatccagtttctgcagcatttccggtatcagttttgtcagtgagatataacgctgcacttgttttgggctatcaccacaatcctcgctgataatctctatcgcccgctttcttggtgttttgtggtcaacttggctcttttttcgaccactttttctttttaatacgtcattcttcaatttgtaagcaaaagctttttcactgtagctgatccgttctctgtgaagattagaatctaccatgcttaaaatggaatcatcttcacttaatacccggataatcaccggcacttttcggtatcccagtttctccgcagcatgttttcttctgtggccggatatgatctcatagtagccatccggtactggtctgacgatcagcggatttaaaatgccatacttctcaatgctttcctgcagaagaaacatttccttatcatctttcacttgaaacggatgctctttgaatggacgaagacgctcaatctcaatttctatgattctttcttcgctttctcctgattgtctgtttggctcagtcatcttgactcctttcctccaggattcaggaaataaaaaatgcctgcctggaacttttatagatagtaaagttccaaacagacattgctgtttgaccattagctgtagctaatagaattgaatactgtttcagctaattcatgtttgcaggtttgggagagattgtttcttttcccgccttttctctgatttacatccccgaataaggggtgacaacggagcggaacccaaatgttagctggacttcttaaaacccatgtttgcaaaccggtaattttgattagctgtcagctaacaaaaatcggattgcgttagctggaaattgatcattttgaatggaattttgtgtcacgaacgtgatttgaaaataacaaaagcgttcgttgtcagctaatccagctaacattttcgaacgctttgaagcccgtcgccaagaggatttgaacctccgacccctcgcttaggaggcgagtgctctatccagctgagctatgacgacacatgccgcaaacccttgattttactgggtttctgggatttttcccttcggccatatataagattatcaactcttttttgagctgtcaatctacagattttttttgctaatgaagcataataattgacacatataaatgattttatactaaccaattcaaaaagtcaaccctggcatggctttttgaacgcagataagcaagtagcaaagcggattgcgaatgtccgctttaccgctttacccttgtcagaacaatggggataaaataaaaaggacatcctatctattgaattttttattttaagatagaacgtcctttttaagttttgctaaaggaagcttttgattaattatttacctgtattatttgctttttttcttcagcagttttgttcctgttaaagttgtgcatgagacagctaagagtgcaatccaaatcataacgtttgtatcatctcctgtttttggagaagtagtggcagaagtacttgttccggttgtggaagttttgcctgtagaggctgttgtttttccattggttgaagtatttgttgtactgcctgttgttttggtggtaccgttcgttttgtctgtagtgctgttatttgcattgttgctgttgtttttattatcgttaccgttattggtattatcgttcttgttgtcgttatcgccgttgttgatattatcgttcttgttgtcgtcatcaccatcatttttattgtcgtcatttttattgtcatcattctttttgtctgtaatagtgaaaacaatttcggcagaggaaccagcgtagttgccgatacctgtaacagttaacctgtagcttccagcgttgataaattctgtatcagcaaaattttttgcttcagaatcatctccgtagatgcaggaaacagtgtaatcaacaccttctgttaaaacagtttttccatcttttacagtcagagtcggtgttttagctgttccatcataagaagcagaatcggaatctaaagcaacatcaaaagtaagttcttttggcgtaatcgtaaatgttttttctacggttccgtagtaatttccaataccggtaactactacagtgtaagtgtctgtgtttgtaaatttaccatcggattctgttccatcttcgtttttgtaagtaatgaaataatccgttccttctgttaaaacagtttctccatcctgtaccattacagaaggggtaagttcttcaccggtataagtctgattttcaatgtctgctacagtgaaggtatttgttacagcatttgttatgaacttatctaatggaggtgtagtttcaacacctgtagtccagtataattcttcaagtgggtcattattgacatcattaccaatctgtgtaccattttcaatatgacggcttgcacttgtaacttttacatttccggaaatggcatttcccggtgttgcgtttttggaagtacgagaggtagctccctgaaggaaagcttcggaagttgtaatcattccgtttccaatgactgcatttccgccgttgccccagagtacgtcgccaccgatagcaataacttttccatttcctgtgatgttaccgttgtctaattcaatagcagaaccgccttctgcatagagaagtacgtttccaccaccaccataagtaacgagtacggcattatcttcaagatttacagttccgtcttttacgagaagggcagtctgtccaaggtcacttcctgcttcatccccggcaataaatacctgtccttttacagttacatttccatttgctacaacaactgcttcagaactgctgcggtctgttaagtcgccgtttgcaagatagttaatgtgagagtaaatagatgcattttcaaggatagcaccatcctgcaggcgaagctgtccacaaagagaagcgcctgtagtaaattcttgattgtaagaatcatagttcatagagaatgtaccgccgttctgtacgtcgatgattccctgaacaacagaatcggaaagagtcagcttaccgccggattctactacgatgcggacactgctgaggatttccatatttgtcatagtcagattgcatccagccggaatgtaaagggtctgtggaatgtctccggcttttacctgtttccatggaaggtcgtatccaagataaccataagtaccactttgatgggaaccaaaccatgcttctaaatcttttggaacacgaacgctgttttcttcgccttctacattgcttccgaagtttttgattgcccatggttccatgatatcccatgcataaagaccatttccatactgttttaaattgtcggtagtcagacggtctgctaaagtttcttcgcctgtgtaaacattaaatggtaaggagttgctgacagcggttcttccctgggtatctgttatagatacggaaataagataagcaccggcatcttttggagtaccgtttaatgtcaagtcactgctgatggtcatgtaaactccgctcatgccactgtcgctgtcggtaggagttcctttttctgtattcggaacaatgctgacactgcatttgcttccgtttaggttgatttttgaagaatggtcaagttcttcccagtctgcgtctgttggttcagtcccttttgctgtgatggcaccgtaaacttttgcagaactgtttttgctgctggtagcgccaccaacacttgcgcttgatacgctgtcatagttctgctgaccaatgatggctgattcaaaagagccttccagttttacgtgaagttcataagggtcgccctgtccgtcatcagcaactaaagaggcatttccatttgtatcaattacaaatttgaaagtcagttcctgatatccatcagcagtaagtgtgataacatcaccgctttttaaaacagggatttcaggatttgtactgaaatcttttgcggagaaaaccaaaacattattatcggtatctttatagtatttaccaccggcagatggtttaaaagaagagttttcccaggattctccatttacttttacgtcggtaacggatgtagcatagttatctgcattttggaaagaaagattccagtttgttccgaagaaatcagttgcaatgcttaactggttcagttcgatttttaccggttcagcaggttttatttttttaaaagaagctgatacagttacatcttcttccggcatgataaaagtataaacaccgtctgtattctgaagggcaacttcagttccggttgttatacctgtaactttaatggtatcaagttcatagttttcagctggtgcaggtgttacggtaacagtagtgccttttttgatttcttttgttgcgctaagctgtacatttccgttttcggtttcggctgcagtagcagaataggttttttcagcaggtgctacaacagttgcagtataaacataaggataagaagaagtattttttgttacctgaaggtttaaatcctgatatccgtccgcagaaattttaatagctgcaggataagtagaaggatttacgattttcagggctgtgtagcttccgtaagcaccggtcacacttccgacttcccagaggtttccgtttgacccccagctgttaatggttccctttgtataagtcgtatcatttacaacgacattattaattgcattcatccagcccatatcttcaaagccaagcgttaagatttcggtcataaatccggtgacagagcattcggtcactgcggttggtgctgctttatctcctgccgctaaaacaggtgagtatgtcgtagacagacaaatcagtaaagataagagcagggacgcaatttttttccatatttttttcatatctctctccttgtaaatatttgatttttctaatgttagaatggctgctaatacgattaaagatagtccccctttcactataataattagcacatctgataaaacaaaagttagtatattctaacaatggtaatacaatgctaccaacaattaccaatggtgtcaatgaaaaaaaacttattgaaaaaaattatctgtaagacacaaaaatgcgatagaaagtatacggaaatcttttatcaaacctataaaaatggtataatgtacccaataaatcaaggaggtgattgaattgaagaaagtagttttaatccccgattcatttaaaggaacattatcttctgcgcagatttgtgacattatggagcagaatgtgaagaaacactttccggagtgtgaggttgttaaaattccggttgctgatggaggagagggcagtgtaaactgttttctgactgctgcaggtggagaaaagagaaaggttatcgttaagaatccttacatggaggatatggaagcattttatgggattttgccggataagacagcggtgattgagatggcagcatgtgcaggacttccgcttgtggagaatcgtcaaaatccagaagtgacaacgacgtatggtgtcggtcagctgatgcttgatgctgtggagcatggttgtaagaagatagtagttgggcttggcggttcgtgtacaaatgatgctggtgcaggagcggcggcggcagttggagttgaattttttgataaagatggagagaaattgattccgacaggcggaacacttggaaaagttgcaaaaatttcgatggaaaatatggatgagcgaattaagagcgcgcagattatcacgatgtgcgatattgataatccaatgtatggaaaatcgggggcagcttatattttcggaccgcaaaaaggtgcggatgatgaaatggtgcagcagctggatgcaaacttaagaaaatttgcagagcggatacagacagaaatcggaaaagatatttcgaatatccatggaggcggagcagcaggtgcaatgggagccggtatggttgctttctttgattcaaagcttcagatgggaattgaaaccgtacttgatattgtaaaatttgatgaattaatccagggtgcagatttgattttcaccggtgaaggaaaaatggacagccagagccttcgtggaaaagtggtaattggagtcggaaaacgggctaagagacaagacgttccggttgtggttgtgacaggagatgcagaagaagtagaagatgcttatgatatggggatttcggcagtcttttcaacgaatcgggtagcaagagatttttcagtaatccgatataagagtaaagaatatatggaagtcacaatggataacattatgaggctgattaaaattgtgaataaatagggagaaattagaaaaaataaaaagagcggagacttggattttaggtgagtccccgctcttttaaatttaagaggtttttgtatatggattagaggtaagttttttatttaaccaaatcaagcaagtagcgaagcggattgcgaatatccacttgactttaatgtgtatagttattaagtagaaaaatttataagttcgagtaacccatcagggaagcgtccactgcctcagcagcttttcgtccttcacggattgcccatacgaccagagactgtcctctgtgcatatctcctgcggtaaatacgccaggaacagaagtttcatactggtcagattttgttgcaacattggttcgtggagttaagtccactttaaatgcatcggttacgtatttctggcttccaaggaaaccggctgcgattaatacaagctgagcttctatgatggtttcactgccttcgaccggaaccatattcatacgtcctgttttttcatcttttttcggttcaagctttacaagttttgctttttgtacgttacctttgtcgtctttgataaattcggttactgtggtctgatagatacgtgggtcatgtccaaagactgcgatagcttcttcctggccgtaatctgtcttgcagatacgaggccattccggccatggattcatttctgttctttcatctggtgcttttggcatcatctcaagctgtgtgacagattttgcaccaagacgaattgcagttccgacacagtcatttccggtatcaccgccaccgattacaacgacgtgttttccttttgcagaaacaaagtttttatctttgaaattggaatctaaaaggctctttgtaatagaagagaggtagtcaactgcaaagaaaatattgttggcttcacgtcccggaactttaatatctcttggattagaagcgccacagcataaaacaatgcggtcaaaatctttttggagttcttttgcagtgatatcttttccgacatctacacctgtcttaaagacaactccttcttcttccatgattttgatacgtctgtcaatcacagatttatcaagcttcatgttcgggattccatagcggagcaaaccgccgattctgtcttttctttcaaaaacagtaacctgatgtccgcgacggtttaactgcatggcagttgcaagaccggacggaccgcttcctacaacggcaacttttttgccggtacgaacttttggaatccttggagtcacccatccgtttgcataagcagtttcaataatggcacgttcattttcctttgtggaaaccggttgggaatccagattacagatgcaggctgcctcacaaagggcagggcatactctgcaggtaaattcagggaaacaatgggttttggttaaacgggtataagcttgttcccagtttccgtgataaactaaatcatttaattccggaactaaattgtgaagcggacatccggaagccattccggcaatcattgtaccggcctggcagaacggaacgccacattccatgcagcgtgcgccctgtttctgttgttcctctttttttaaaggggtacgaaattcgttaaagtgtttaattcggtcttttggtgcttcgacttttgctgtctctcttttatattctaaaaatcctgttggttttcccatgattattctgctcctttctgaaagttttcattgaaggcttctaactgtgcttcttctggtgacatgcccatttcttccagtctggtagccatagtaatcatctttttgtagtcatccggaataatctttttgaatttcggcagatattcctggaagtggtcgagtacttcctgacctttttcagaaccggtagcagcaacatgagctgcaatcatgttatgaagttcctgaatatcagattttaattctactttttcaatagaaatcatagatttattcaggtttttatacaattcatttttatcatcaagtacataagcgacaccaccgctcataccagctgcaaagttcttgccggttttgccaaggacaaccacacgtccacctgtcatgtattcacatccatgttcgccgacaccttcaacaactgcgtaagcaccggagttacgaactgcaaaacgttcaccggctacaccacagatataagcagtaccgcttgttgcaccatagagagcaacgttaccggtaataatgttttcatctgctttataatttcttttcttcggaggataaagtacaatcttaccaccggagagacctttacccatgtaatcgttgcagtcaccgcagagagttaaagtgagtccttttggaacgaaggctgcgaaactttgtccgccggctccattacagttgatggtgatggtatcatctggcagtccgtctttatgatgtcttgtaatttctgcgccaaggatggtagcaaatgcacggtctgtattggtaacttctacatcgatagaggctttttcgcctttttcgatggatttctgaagttttttcagaagaattttttcatcttttgtctcttccagtttgaagtcataaacctgagccgggtcgaaggttactttctgtccttctttggcgaatggattatttaagattgcacttaaatcaatcttagatgccatcgggctttccggatgttcttttacttttaagaggtctgttcttccgaccatctcatcgagtgtacggattccaagttttgccatgtattcacgcagttcctcggcaataaagcgcatgaagtttacaacatattccggttttccacggaaacgttttctaagttccggattctgagtagcaacaccaaccggacaggtatctaagttgcagactctcatcataacgcatcccattgttacaagcggagcagtagcaaaaccaaattcttctgcaccaagtaaagctgcgattgcaacgtcacgtccactcattaatttaccatcggtctcaatcatgacacggttacgaagtccgttcataagcagagtctgatgagtttcagcaagaccgagttcccatggaagtccggcattgtggatagaactctgcggagcagcacctgtaccaccgtcataaccggaaatcaggataacctgtgcaccggcttttgcaacaccggctgcgacggtaccgacaccggcttcagaaaccagttttacggaaatacgggcatttttatttgcatttttcaggtcgtagattaactctgccaaatcttcgatggagtagatgtcgtggtgcggtggcggagaaatcaggctgacacctggagtggaatgtctggtttttgcaatccaaggataaactttcttagcaggtaagtgtccgccttcaccaggttttgctccctgtgccattttaatctgaatttcttttgcactgactaagtaacggctggtaacaccgaaacgtccggatgcaacctgtttgattgcagaacaacggtctactttgcttccggcactgtcaagacgctcatcactttctccaccttcaccggtatttgattttccgtgaagcatgttcattgcgattgcaagtgtttcatgagcttcctgagaaatagaaccgtaagacattgcaccggttttaaagtgttttacgatttcatctacactttctacttcctcaatcgggataggattttcagcaaaattgaaatccatcaaacttctcagataaccactctgttctttatcaaccatgctggtgtactgtttgaataggttataatctccacgtttggttgcctgctgtaatgcatgaatggtctgtggattgtaacgatgtttttcaccttcactttttgctttgtgcataccaagactgtcgagctgaagatttgtggtaagtccaagtgggtcaaatgctttggagtgacgggcatcaacatctttttcaatatcttttaaggtaataccaccgacacggcttacagtaccggtgaaatatttttcaatgacatcggcggaaataccgattgcttcaaaaatcttagaaccctgataggactggatagtagaaatacccattttagaagcaatttttacgataccgtgaaggattgcggaattgtaatcatttacggcagcgtagtaatctttatttaataagttattgtcgattaattcctggattgtatcctgtgcaaggtaagggtttacggcacatgcaccataaccaagcagggtggcaaagtggtggacttctcttggttcaccggattcaagaatgatggcaagagaggttcttttctttgtttttacaaggtactgatgaactgcggatacagctaacagagatggaatcggcatgtggttttcatcgaccccgcggtcagagagcactaagatgtttgctccatctttataagctttgtcaacttctacaaaaagacggtcaattgcacggtcaagcggtgcactcttataataggtaatcggaacaacagccactttaaatccttttacattcatgtgtttgattttcagcatatctgtgttggtcaaaatcgggttgttgacttttaatacctggcagttttcaggctgttcgtgaagcaggtttccatcttttcctacataaacggttgtgctggttacaatttcttcacggattgcatcgataggcgggttggtaacctgtgcaaaaagctgtttaaaatagttaaataatggctgatgtttttctgaaagaacggcaagtggagtatctgtacccattgcagcgattccttctgaaccatttaatgccatgttataaatggactgacggtattcttcgtaagtgtagccaaatgcctgctgcatttttgtcagttccgtaccttcataatcctcaacacgcacgtttggaatttttaagctctttaattcgaccagattgctgtctagccattcaccataaggctgtttggttgcatatctttcttttaaggtatcatcatctacaatttccccttttacagtatcaactaaaaggatttttcctggatgcagacgttcttttaatacgatgtcctcttcaggaaccggcataacgccaacttctgaagaaaggataacgtcaccgctctttgtgatatagtaacgggatggacgaagaccatttctgtcaagtacagctcccataacatcaccgtcagagaacaggatggaagcaggaccgtcccaaggctccatcatagttgcgtagtactgatagaaatcacgtttttcctgagttaaggtctgattgtttgcccatggttcaggaatacagatcataacggcaagtggtaaatccataccattcataactaaaaattcaagagtgttgtcaagcattgcggagtcagaacctctggtatcaacaaccggaagtactttatgaagctgtccttttagatagtcagaagccatggtttcttcacgggcgagcatcttatcggcatttccacggatggtgttgatttcaccgttatgtaccataaaacggttcggatgagcacgttcccagcttgggtttgtgttggtactgaaacgggagtgaaccattgcgatagcggattcataatctgcatcctgtaaatctttaaagaatgtacgaagctgtccaacaaggaacatacctttgtaaacgatggtacggcttgacatggaagcaacgtaagtgttgtcattactctgttcaaatacacggcgtgcgatgtagaggcgtctgtcaaatggaagtcctttttcgacatcatcaggtttctggataaatgcctgaacgatatgtggcattttttcgagtgctttgtgtccaagtacttccggacataccggaacatcacggaatcctaaaaattccagaccttctttttctacgatgatttcaaacatctttttcgcctgattgcattttaattcatcctgtggcaggaagagaacggcaataccgtattctctttcgccaccgattttgataccctcttttttgcaggctttggaaaagaatttatgtgaaatctgaagcaggataccaacaccatcaccggtttttccttctgcatctttaccggctctgtgctctaagctctctacgatttttaatgcattttcaacagttttgtggcttttgatacctttgctgtttacaactgcaccgataccgcagttatcatgttcaaattgctgtcgatataaaccttgttctctcataatgattgacctctttcctttttatatgtggcagccgcctgcaccagtcctttaaatagcggatgtgcatgattcggtcttgattttaattctggatgaccctgagtaccgacgaagaatggatgctcggtaatttcaatcatctctacaattcgtccgtccggagaaagtccgacaagactcattccattttcttcaagctgtttacgatagtcattatttacttcatagcggtgtctgtgacgctcggcgatatcctgttttccatataattcgtaggattttgttccttcttttaatttacaaggataagaaccaagtcttaaggttccgcctaagtcttcgattccgtcctgttccggcataagagcaatgactggatgaagggtgtccggatttaattcaatgctgtttgcatcgtgatatccgaggacatttcttgcaaattcaataattgcaacttgcataccaagacagataccgaggaatggaattttgtgttctcttgcatactgaacggcaagaatttttccttcggttcctctggttccaaaacctccgggaacaaggattccgtcgagtccttttaaagattcctcataattttctatggtaagatgttcggaatcaatccagtggatgtggacattggcatgatttgcgataccgccgtgttttaaggcttccactacacttaagtaagcgtcatgaagctgaatgtattttccgacaattgcaatgtctacttctgtctgaggatgtcttaaatcgtttaccattgatttccagtcatccaaatccggttgtggacaaggaagttttagtgattcgcatacaacctgtgccagattttctttttccatggcaagaggtgcttcatataaatattctacatcaagattctgtaatacgtggctttgcggtacgttacagaataaagcgattttatctttaatatcctgaccaattggatgttcggaacggcagactaaaatgtccggctgaagtcccattccctgaagttcttttacacttgcctgtgtcggttttgtttttaattctccggatgcctttaaataaggaatcagagtaacatgaattaagatagcattttcatgtccgacatcatgctgaaattgtctgattgcttctaagaatggctgactttcgatatcacctaccgtaccgccaacttcgataatagcgattcgctcttcatcaggaaattttgcacggtagaaacggcttttaatttcatttgtaatatgagggataacctgaacagtccctccgccgtaatccccatgtcgttctttttgaagaacggaccagtaaattttaccggttgtaacattggaatttttatcaaggctttcatcaataaagcgttcataatgtccaaggtcaaggtcagtttctgtaccgtcgtctgtgacgaatacttcaccatgctggatgggattcattgtacctggatctacattaatgtaagggtcaaacttctgcatggtgacctgatagcctctggcttttaataagcgtcccaaagatgcggcggtgattccttttccgagaccggaaacaacaccacctgtaacaaatacatattttactgccatcacattttcctcctgctgttgtttcattatcagaaacaggttatgcggtcctgagtctgataaataagataatttcatgggattgccgtgaaatcaaaaaaaaggcgtcgaaactcccatagaaaatactatggaaattcgacgcctttgtcgttttctattcattatgtaagttatcagtcgttttcgggaagttcttggaactccgaaaattatgcaaatactatagctcatttttttttatttgtaaatcccttttttgaattttttttttgaaaaaatttttttaaaaaaagtgattgacaaatttctttttccgtgcaatactacatggcataaagcaaaggcgctttgaactacaaaagttcagagtgccttttttgtttttaccagagtcaaaaattgaaaaccaaaccaatccgtaggtaaaaacaaatttgagtaataattttaaaagcaaaaacaatcacatgaagaaaaatggaaaggagtgctgtgaatatgtcaaaagatattcctacactgtatggaagccttgttttcagtgacaaggtaatgcgtaacaaattaccgaaggatgtttacaaagctcttcgcaaaacaattgaaaatggaactcatctggaactggatgttgcaaattccgtagctgttgccatgaaagagtgggcagtagaaaacggagcaacacatttcactcattggttccagccaatgacaggatttactgctgaaaaacatgacagctttattactccggttggagaaggcgaagttatcatggaattttcaggaaaagaactggtaaaaggtgagcctgatgcttccagctttccatccggtggtttaagagctacatttgaagcaaggggttatacaaactgggatccaacatcaccggctttcattaaagataataccttatacattccgacagcattttgttcctggagtggagaggcgctggataagaaaactccgcttcttcgttctatggaagcgttaaacaaagaagctgttaagattttaaatttattaggaaatacagaagtaacaagtgttacaacaacagtgggtccggaacaggaatatttcttaattccaaaagaattatatgcaaaacgccgtgacctgatttttaccggaagaactttattcggagcttccgcaccaaaaggacaggaaatggaagaccattactttggtgcattaaaaccaagagttgcagcctacatgcatgatttggatgaagagttatggaagcttggtattccggcaaaaacaaaacataatgaagttgctccggcacagcatgaactggcaccggtatttgataccacaaacgtagcggttgaccacaatcagctgacaatggaaattatgaagaaagttgcagaaaaacatgaccttgtctgcctgcttcatgaaaaaccatttgatggaatcaacggaagtggaaaacataacaactggtctgtttctactaatacaggagtaaacttattagacccgggaaaaacaccggcagaaaatattcagttcttagtgttcttagtagcagttatcaaagcggtcgatgaatatgctgatttaatgcgtgtttctgcttcaggagccggaaatgaccatcgtcttggtgcaaatgaagcaccgccggcaattgtttctatctttatcggagatgaactgacagaagtcttaaaatcaatcgaagaagataaattcttcagcgcacataaaacaattcagatggatatcggtgctcatgtacttcctcattttacaaaggatacaaccgatagaaaccgtacatcaccatttgcatttaccggaaataaatttgaattccgtatgcttggttcttctgcatctgttgcaggtccgaacgttgtattaaatacagcagttgctgaggctctggcacagttctataaagaactggaaggaacagcaccggaagatatggaaacagcagtgcatgaattaatcaaacgggcaatcagaaaacataaaaaagtaatcttcaatggaaatggttatacagacgaatggattaaagaagcagaggagagaggactttataatctggtttctactccggatgcacttccacagtttatcgctgataaaaacattgaattatttacaaaacatagtgtatttacaaaagaagaaatttattctcgttatgaaattttacttgagaactatgtaaagactatcaatattgaatctaagactttacaggaaatgctgacaaaagattttattccggcagttaacggatatgcagcagaagttgcagtcaatgcaaatgaaaagaaagcattaattgagggtctgtcaacaacagccgaagaatctcttgtaaaagaattaacagaagcttctaatatcttatctgcaaaagtagcagaattaaaagttgtaacagaaaaagcagatgcggcagcagaagaagatatgcagaaagcagcagaatctttccataaagatgtattaactttaatggatgaaatgaaagatgttgcaaattcagctgaggaaaagattccagacgaagaactgccttatccaacttatgaccagatgttattttatgtttaaggagagggagtcatggaattcttaccagaatgtgaaataaaagaagaatgtggtgtatttggaatttttaatccggatggcggagatgttgccccatctatctactatggactgagttcacttcagcatagaggtcaggaatcctgtggtattgcagtctgtgataccatgggaccaaaaggcaacatgaatgcacataagggtatgggacttgtgaatgaagtatttaaagaagaaactttaaataatcttcacggaaatcttggagtcggtcatgtgcgttactccacaaccggagctgcaaatattaataatgcacagcctctggtattgaattatattaagggaacacttgcgctggctcacaatggaaatctggtaaatacagcagagcttcgctcagagttggaacgaaccggtgcaattttccatacaacaactgattcagagctcatagcctatttcattgcaagagaaagggtaaatgcccacaatgtagaagaagcaattcttcatacagcaaaaaaaattcgtggcgcttatggattggtaattgccagtccgcgtaaactcattggcgtcagagaccctcttggcttaaaaccactttgtctcggaaaacgcgatggaagttatatgattgcctctgaaagctgcgccctttctgcaatcggcgcagaatttatccgtgatatccgtcccggcgaaatcgttacgattaccaaggacggagtcacatcgaattgtcagctttgccaggaaaaaagagcacattgcatttttgagtacatttattttgcaaggcttgacagtacaatagatggtattaatatttacgatgcccgtattcgtgcaggtgccgcacttgcggctgcttatcctgtcgatgcggatttggttgtgggagttccggactcaggtattcccgcagcgaagggctattcagaagcttccggaatcccgttcggaatagccttttataaaaacagctatgtgggaagaacatttattaaaccgacacaaaaagaacgtgaatccagtgtacgcttgaagctgaatgtattagagccggttgtccgtggaaaacgaattattttagtggatgattctattgtccgtggaacaacaatggcaaatctgattcggatgctcaagaaagcgggagcagtaagcgttcatgtacgtgtgagttctccgccgttcctgtatccttgctactttggaacggacattccatccaacaaacaacttattgcgtcttcccacacagcagatgaaatcagagagataatcggtgcagagtcacttggttatatgaaattagaagacttgcagtcaatggtaggagaactgccaatctgcagggcatgtcttgatggaaagtacccgatggatattacaggacataccgaggacaaaaaacagtaattgcggaaatgtaaggcattttccgattacatatatcacattcgatacctggaaattgctggtctaaaaaacagcttttagactttcgaccctggtatcatcacatttttctttatgcgacggtgcgtattttgtgagagcaaagtgcgcacctttttgtattttagaaaaatgttgtataaataaaatttagaaaaatgtgagcttgaggaaaggggaaattaatatggattattcagcagtaaatacgatatgggtgcttcttggcgccgcattagtattctttatgcaggctggtttcgctatggtagaaaccggttttacccgcgcaaaaaacgccggtaacattattatgaaaaacttaatggacttttgtatcggaacaccggtcttctggctggttggtttcggaattatgtttggtgcgggaaatggcttttttggttcgatttccggtatcgcttcagaaagtaattatggaacagcaatgcttccggatggagttccgttttgggcatttctgatttttcagacagtattctgtgcaacatctgcaacaattgtttccggtgcaatggctgagagaacaaaattctcatcttactgcatctacagtttcttaatcagtttagttgtttatccggtatctggtcactggatttggggcggcggctggttagcacagatgggatttcatgatttcgccggttcctgtgccgttcatatggtaggtggcgttgctgccttagttggtgcaaaaatcttaggacctcgtattggaaaatattcaaagagtggaaaatcaaaagcaattccgggacataacctgacaatcggtgcacttggtgtatttatcttatggttctgctggtttggatttaacggtgcatctaccgtttccatggaaggcgatgcaattgtaaccgcaggtaaaattttcgtaacaacaaaccttgcagctgcagttgcaactttaaccgtacttgcaatcacatgggtaagatacaaaaaaccagatgtatctatgtccttaaacggttccctggctggtctggtaggaatcaccgcaagctgtgataccgtatctccgacatctgctgcaattatcggtatcttagccggatttgtagttgtatttggtattgaatttatcgacaaagtatgtaaaattgatgacccggttggtgctgtcggtgtacacggaatgtgtggtgcacttggaaccctttgtgtaggtcttttctctgatggaacaggtacagagtggaaaggacttttcacaggcggtggatttaaattattagaagttcagtttatcggatttatcgcaaccgttgcatgggttgttgtaacaatggttatcatctttaatgtattaaaacataccgtaggtcttcgtgtatctgccgatgaagaaatcgcaggtctggatatcagagagcatggtcttgcaagcagttatgcagactttgttacaacagataacatgggcggtggaaatgttccaaacgtaatgggaataaagagaggaccggtagaatctccggctgcaactcaggctccggcagaactggtgaaagatccgaaagttggtaccgatgtacataaactgacaaaagtggttattattacacgtagaaataaactcgatgactttatgcaggcaatgaatgaaatcggtgtaacaggtgttaccatcacaaacgtattaggctgtggcgtacagaaaggtgcaaccgcttactatcgtggtgttgaaatggatatgaacctgcttccgaaagtaaaaattgaaatcgttgtaagcttagtaccggtcgaaaaagtagtggaagctgcaaaagcagtgcttcataccggacagattggtgacggtaaagtcttcgtatatgatattgaaaatgtagtgaagattcgtaccggagaagaaggttatctggcacttcaggatacctcggaagagtaaaaaagttaaaaaaaaagaccatctaaaaaaagatggtctttttctattgacaagaaaaatcgagattgctataataccaaacataaatgaaagaacaaaggcgttcttatttggagggtaaaactctctaaataagagcgccttttttgttgattgaataaaaaaacaactcgtaagagagaggagattatgcatggaaaattacacgaaggaagccatattgcagatggcagaagaggaagatgtcgaatttatccgtcttcagtttacagatatgttcggatgcctgaaaaatattgcaattccttacagtaaactggagaaagcgatggataataaatgtgtgatcgacgtttcttctattgaaggatttgtccgtgatgaagaatatgacatgtatttatatccggatttatctacgttttccattttaccgtggcgtccacagcagggaaaagttgccagatttgtgtgcgatatttacaacgaagacggcactccttatatagaaagtccaagatatattttaaagaaagcattagaaaaagcgaaagcaaaaggttataccttgatggtcaatccggagtgcgaatttttcttattccataccgatgataatggaatgccgacaacaacaactcatgaaaaagccgggtatatggatttgagtccgattgatttaggtgagaatgcaagaagagatatggtattaacattagaagaaatgggatatgatattgaatcttctcatcatgaaattgcaccgggacagcatgagattgattttgaatattctgaggcgatggaaacagctgataaggtcatgacctttaagacagcggttcgtaccattgcaaaacgtcacggactgcatgcgacatttatgccgaagccgagagccggagtgaatggttcagggatgcacgtcaatatgatgttaatgaaagatggaaaaaatgtattcaccgacaaaaatgatgaacttggattaagtaaagaagcgtatcagtttatggccggtatttttgctcatatcaaaggcatgaccgcaatttgcaatccattggttaactcttataaacgtctggcaccgggatttgaggcaccgtctgatattacctggtcttcgagacagagaactgcactgatccgtgttccacaaaatgtagaaggtggaaccagattagaactcaggagtccggatgcatcttctaatccatatctggtactggcgctttgtctggaagcaggtcttgacggaattgagaaacagatggaactctcaccggaattaaaacgaagcataaggaaattaaacaaaaaagaaaaagaagaaatgggaatcgattccctgcctgagaatttaaacgatgccttaaatgagtttcatgcagatgaattggtcaaagaggtattgggaaaagattttacaaaatattatctgaaagcaaaaaaagaagaatggttagaatacatggagcaggtatctgagtgggagcttgaacagtatctgtaccgtgtgtaaaaaataaagagcaggaggcagtacatgagcagcatcattattgtattaccaaaaatcgaagatgcgaaaaaaatcaggaaaatactgatgcagcatggatttgatagtatcataccatgcgctacaggtgcctctgcccttatggaaatgaataaacagtccggagggcttgtaatcagcggatataaacttccggatatgtattacaccgaactcgcagacatgcttccgagtttttttgatattttattgattggttcagcaaatgtggtaagttccgcacagtcaggaatcatggcagtcacaatgccgattcgggttcatgaactggttaacaccgtggaaatgcagatgatgcagattcagcgtcgtttaaagaaacagaaaaagaaaccaaaaccaagaagtgagagggagcagaattatattcagaatgcaaagcggcttctgatggacagaaaccatttgacagaggaagaagcttacagatatatacaaaagtgcagtatggacagtgcaaccagtatggtcgagactgcacagatgatattgactttaatctatgatgaagtataagcataaagacaagtataagcataaaggagaaatgtgatatgtttacaattaatgaaaattatctgaaactgccgggaagttatcttttttctaacattgcaaaaaaggtaaatgcgtatcaaagtgaaaatccggaggcacagattcttcgccttggaatcggagatgtcacacaaccacttgcaccggcaatcattgaggctctgcataaagcagtagatgagatggcaaatgcagaaacctttcatggttatgcaccggaccttggttatgaatttttaagaagtgctattgcaaaaaatgattacaaagaccgaggctgtgatattgcagcagatgaaatctttgtatccgacggtgcaaagtgtgattccggtaatattcaggaaatctttggcttagacaacaaaattgcagtatgcgacccggtttatccggtttatgtagacaccaacgttatggcaggaagaagtggggaatataatccaaatactcagaactttgatggcatgatttatatgccgtgtctggaagcaaatgattttgtgccggagttcccaaaagagaatccggatatcatttacttatgtttcccaaataacccgaccggtgccacaattaccaaagcacagcttcaggaatgggtagattatgcaaaacgtatcggtgcagtgattatctatgatgcagcgtatgaagcatatattacagaggaagaaatcccacacagcatttatgaatgtgaaggtgcaagagagtgtgcaattgaacttcacagtttctcaaaaaatgccggatttacaggcgttcgtcttggatataccgtagttccgaaagatttaaaatgcggtgatgtacagcttcattctttatgggcaagacgtcacggaacaaaatataacggtgctccgtacattgtacaaagagccggtgaagccgtttattcagatgccggaaaagctcagttaaaagagcaggttgcttattatatgcagaatgcaaaagtgatttatgaaggcttaaaaaatacaggatattccgtatccggcggtgtgaatgccccttatatctggttaaagacaccggataaaatgacttcatgggagttctttgataagttacttcatgaagcaaatgtagttggtactccgggaagtggatttggtgctcatggagaaggatacttccgtttatcagcattcggaagtcatgaaaatacaataaaagcagtagagcgaattacaaagatgtaataacaggcgtgagaacgcgtgatttgcgtcccggggtctggatgccccgggatgtctgtttttaaaaacgcgataaaggagaaatgtgatatggaatttgttacaggtgtaaaagaaaaagaagcaatggaactgccagaagtgatcatacaggaagaaggaacagaagttatcgtagagggtgcaattcacagtatccgaaatatgggtgagattgcatttgtcatcttaagaaaaagagatggtctcattcagactgtatgggaagaaaataagacaaatctggatatctctgaattaaaagaagctgcctgtgtcagtgtaaaaggagtcgtaaaagacgaagaaagagctccgcacggaaaagaagttcgtctggaacaaattaccattttatcacagccgactgctccgcttccacttgcgattgataaatggaaattaaatacctcacttgaaacgaaactggatatgcgttcggtttctcttagaaacttaaaagaaagagcgagatttaaaattcaggaggcaatctgcagaggatttcgtgagtatctttatgcacaaggctttacggagattcacactccaaagattggggcaaaaggcgcagaaggtggttccaatatgtttaagttaagttatttccatacaccggccgtgctggcacagagtccccagttttataaacagatgatggttggggtgtttgaccgtgtcttcgaaaccggcccggtttttcgagcagagaaacacaacaccagacgtcatttaaatgaatataccagtcttgattttgagatgggatacattgacagtttccttgatatctgtgaaatggaaaccggatttttgcaatatacgatagaattattaaagaaagattatgcaaaggaattaaagatgcttggaatcacacttccaaacgtggaaaaaattccatatgtccgctttgatgaagcaaaacgtctggtatctgaaaaatataacagaaaaattcgcaatccatttgacttagaaccagaagaagaagagttaatcggtaaatattttaaagaagaatatgatgccgattttgtatttgtcacccattatccgtcaaagaagagaccgatgtatgcaatggatgacccggaagatgacagatataccttaagctttgacctcttatttaaaggacttgagatcacaaccggaggtcagcgtattcatgattataacatgctggtagaaaaaatcgaaaagagaggcatgagccaggaaggaatggaacagtacttagataccttcaaatatggcatgccgcctcatggtggacttggaatcggactggagcgactgacgatgcagcttttaggagaggacaacgtaagagaagcatgtctgttcccaagagatatgaaacgtttggagccgtaagaaaggagaaacagccatggcaaagcagataattgatgatacagtaatggaaaatgtagaaattcttgcaaaacttgcccttacggaagaagagcggaagaaagcaaaagaaaaaatgcaggaaatgctggattatgttgataaattaaatgagttggataccgatggaattgaacctctgtcccatacattttctatgggaaatgtattccgtgaggatgtagtcaccaatggagatgacagggatgcaatgcttgacaatgcaccaaaatgcaaagacggacagtatcaagtgccgaagacggtacagtaggaggaaagggtatggatttgaaagatttaagtgctcttgaactttccactgcgattaaaaaaggagaagcaggtgtggaagaagctgtaaaggtgtcactcgaacagataaaaaaatcagaagacactgtacatgcatttcttgagacagatgaagaaaaggtatatcaaagagtaaaagaagtagaagcaggaattgcttccggaaaatatagcggaccgcttgcaggtgttccgattgcagtcaaagataatatctgcacaaaaggcagaaagacaacttgtgcatccaaaattcttggaaattttgttccgccttatgatgcagaagccgtgaaaaaattagaagaagccggaatgattattcttggaaaaacaaacatggatgaatttgccatgggaagtaccagtgagacatctgcatttggaattaccacaaatccatgggatcagacaaaggtaccgggtggatcttctggtggttcatgtgccgcagtggccgcaggagaggctttcctggcacttggttcggataccggtggttcgattcgtcagccatcttcttactgtggtgtggtcgggatgaagccgacttatggaacggtttctcgttatggattgattgcgtatgcctcttcacttgatcagattggaccggttgccaaaaatgtggcagactgtacggctttattagaggcaatttccggatacgataaaaaagacagtacctcgattgaaagaaatgatttgaactttacagaagcgttaaacggcgatttaaatggggttcgtgtcggtattcctattgaatatctttcagagggactcgatgaagatgtgaaaaaaacacttcaggaaaccgtagaactgatgagggcaaacggagcagtggttgaagaattttctcttggactcgttgactatgtgattccggcttattatatcattgcttccgctgaggcaagttccaacctggcgcgttttgatggcgtaaaatacggttatcgcgcagagaaatttgaaggacttcatgatatgtataaaaagagtcgtgcacagggatttggagaagaagtcaaacgaagaatcttacttggttctttcgtattaagttccggctactatgatgcgtattatttgaaagcattaaaagtaaaagccatgattaaaaaagcatttgatgatgcatttgcaaaatatgatatgattctggcaccggcagcaccgtctaccgcaccgaaggtaggaagcagtttacaagacccgcttaaaatgtatttaagtgatgtctacaccgcaggggtaaatctcgcaggtcttccggcaatcagtgttccggcaggaaaagacagaaatggaatgccggttggtcttcagtttatcggagactgctttaaagaaaagaaaattatacaggcagcttatgcttatgaaaaaatccgtggagtatttcctatggcatatcagaaggagggaaaatagatggcaaaacaatatgaaacagtcattggacttgaagttcatgtagagcttgccacagcgaccaaaatcttctgcggatgctctacgaaattcggaggcgcaccaaatacacatacctgtccggtctgcaccggtatgccggggtctcttccggtcttaaacaaacaagtggtagaatatgcacttgcacttggacttgcagcaaactgtgaggttaatcagaactgtaaatttgaccgaaagaactatttctatccggataacccacagaattatcagatttctcagttatatctgccaatctgccatgatggatttctggaaatccagaccaatgcaggaacaaagaaaatccgtattcatgaaatgcacatggaagaagatgcaggtaaattaatccatgatgaatgggaagactgctccttagtagactataaccgaagtggggttccgcttgtagaaatcgtatcggaaccggatatgagaaatgcagaagaagtgattgcatatctggaaaaattgagaatgatttgtcagtaccttggtgtgtctgactgtaaattacaggaaggttcgatgcgtgccgatgtcaacttatccgtacgtgaagttggcacagaaacctttggaacaagaacggagatgaagaacttaaactcctttaaagcgattgcacgtgcgattgaaggagaaagagaacgtcagattgaactcatagaagaaggaaaagcggttcagcaggagaccagaagatgggatgacaacaaggaatattcctatgcaatgcgttccaaagaagatgcaaaagactaccgttacttcccagaccctgatttaccgccggtctttatcagtgatgaatggataaaacgtatcaaagacagccagccggaacttcaggaagcaaaatctgcacgttatgaaaaagagtatggactttccgtttacgatgcttcacttttaacccagtccaaacatcttgccgatttatttgaagaaaccgtaaaagaaagccagaatccgaaaaagaccgcaaactggtttatcggtgaaaccctgcgtctgttaaaagacagaggaatggaagcagaagaactgcattttactccaaaacatctggcagatttaattcttatggctgaaaaaggagaagtcaataaccagaatgcaaagaaagtctttgaaaagatttttgatgaagatgtagaaccgaaggcttatgtagaaacaaatggattaaagaccgtagaagataccggtatgcttgaatctgttgtcgataaagtacttgcagataacccgaaaactgtagaagaatatcatagcggaaaaacaaaagtgcttggattcttagtcggacaggttatgaaacagatgaaaggcaaggcaaatccggcgtctgttaataaaatgctgatggagaaactgtgattaattgcatgcctgtttcttttaccgaaacagtagaaattatttttggagccatagaatagtagaaattgtattttaaaaatattggctagttcggggacagaaatcttgtccccggacttttttatttcataggattctttttatgtgctatgcttcattcttctcattctgctcaaccagataatccagtgaccgaaactgataccccatctcttcccatttgccaagcaattcatctagaatttgagcattggttgatgaggtgctgtggagcagcacaattgcgccggggtgaatccggttaagcagtttgtcgaaggcttcttcttttgagggctggttatcctggtaccagtctacataagcaagactccagaagaaggttttataacctaaatcttttgccatttttaagttggtttcgctgtatttgccttgaggagggcgataatattttttcatttcctgtccggtagcctctttgtataaatcagaaagttcctgtaattcttttgagaaggaatcaatggaagaaatctgagacatatccggatggtgataagaatgattgcctacgatatgtccgtcggaaatcatgcgtttgacaatttcaggacttgtggagagaaaatttccaacgacaaaaaaggtcgcaggggcattgtgcttttttaaagcatctaaaatgatttcagtattgccattttcatatccgcagtcaaaggtgagataaatatttttttcatcggtgtcttgtgcatagtaggcgtcatattgctgtaattcttcgatagaggcatttccgacaggacgttttccttcttcctgaaagcttagcccccagttgccgactgcattggaaatggtttcctgtgcggagtaatagtggatggcaaagcttaaaaaatttccaaatgcaaaagaagcagtaagcaataaaaaaagtgcaagatactttaaaataaaatttctatgtaacataaaaaatcctaaatgcattgttgttacctaatatattgagaaaaaaggaaaaatatcacagaaaaagtgagattgcgaaatcctcaaaatcatgttagagtaaaaaaacagaagagaaagataaagagaggagaacaaaggtgaatagaaaattaattttctttgatatagatggaacaattattccggaagatacaggagtaattccggaaagcacgaaagaggcaattaaaaaagcaaaagaaaacgggaatctggtttttattaatacaggacgtacttttagcggaattacccagccgatttttgatttggaatttaatggttatgtctgcggatgtggaacgcatatttattttgatggaaagaaaatctattcctctgtgattccgaaagaaaaatgcattgaaacggtagctattcttcgaaaaaataaagtaaatgctttttacgaaggagacaagggaatttattttgattacagctattcgaatccgtttatggaacgggcaaaaaaaatgcttagaacgaatggtaaatcggttgaagtgatattagaagataaggatgaagtatttgataaatgcctgattaaattcacagatgaggatatcaataagaaagatatcattatgccattttttgaagcaaattattattgtattgaccgtggagaagatatgtgggagatggcacagaaaggtcacagcaaggcaacaggaatccagaaagtctgcgaatatcttggggcagatatcgatgactgtattgcaattggcgacagcaccaatgaccttgatatgttaaaggcagtaaaaaacagtgtggcaatgggaaattccatggagagcattcttccttactgcagttataagacaacagatattaaggaagatggaatttataatgcactggtatattttggaattatctaatgtttccggtagattgttttttcaaggtttagatattcgcgaaactttcttggagtatatccggtcatttttttaaactgattgctaaaatcggcagcatctttaaagccacaggaataagcaatttctgtaatgctgtagtctgaagaagaaagcatatcagatgcaatgtggattcttaattgaagcagatattgtttcggagaaattttctgctgttccataaaaagacgatagagataagtccgatcaattccaatagcggctgcaatgtcctgaatacggatgttgtagccgtaattatttttcatataatccattgcgcgttttacatattgagtggaataagagtttccttctacaacagacggaccagtcatcaaaccaagaagttcaagaaacaaacctgtcagagtaaaaggattatagttggctgaagagaaagtatttaagatagaatgcatcagagtccgcagattcaactttcgttcagaatcaggaggacaaataaaaatacaggagtcctgaaaacaggtctggtttaaaagggcagggatttcctgtccattaaagccaatccatgcatattcccagggattggtttggtcggcttcatagtaggtagagtccattggtttgattagaaaggagtctccggacttgagagaatacgtatgtccttgatgtttaaaaataccttttccggaaagtacaacatgaatcaaataatgaggacgtacggcaggaccgaaagagtgtccgggctggcagtgttcgtgaccacaaaaataaatagatggaattccggacagagactggttcataaataaaatcctccattttacaacatttttacaagttttgagaaacaaatcagatagaaagtccttttctttgattatataataagaatcataaaaagacaacggattatgataaaatcaaggaggatgaaaaatggcaaaaataacgtttatgggagcaggaagcactgtttttgcaagaaatgtattaggagactgcatgtgtagtgaagcactctgtgaaagtgaaattgcattatatgatattgatgcaaaacgtctggaagattcagagattattttaaatgcaatcaacaaaaatgtaaatgagggccgtgcacagattaaaacatatctcggtgtggaaaatcgaaaagaagcacttagaggagcagattttgtggttaatgcgattcaggtgggaggatatgacccttgtactattacggactttgaaattccgaaaaaatatggtttaagacagacaattgcggacagccttggaattggcggaattatgagaggtctgcgtacaattccggtgatgcaggaatttgcaaatgatatcgaagaggtatgcccggatgcattatttttaaattatacaaatccaatggggattttatccggctatatgcagagatatacaggggtaagaaccatagggctttgccacagcgttcaggtatgctcaaaagatttattgacgaagcttggcatggaagataaattagaaggtcgtgtggaaacaattgccggcattaatcatatgggctggctgttagatatccgtgataaagatggaaatgatttatatccggaaatcagaaaaagagcagccgagaaaaatgcaacagaaaaacatgatgatatggtacgttttgagtatattaaacgtttgggttattattgtacggaatcaagtgagcacaatgcagaatacaatccattctttatcaaggcaaaatatccggaactaattgaaaaatacaatattccgttagatgaatatccaagacgatgcatcaagcagatcgcagaatgggaagaagagaaaaacaatatcttaaaagacggaaagattacccatgagcgaagcagagagtatgcatctcatattatggaagcagttgtaaccaatcagccgtataaaattggtggaaacgtaatcaataaaggcatgattgaaaatcttccggcggatgcctgtgtagaagtaccgtgtatgattgacggaaatggagtcaatccatgcagagtcggaagacttccggtacagctggctgcaatgaatatgacaaatatcaatgtacagctgcttaccattgaagcagcagcaacgaaaaagaaagaatacatctatcaggctgcgatgcttgaccctcatacagcaggagaactttgcattgatgatattgtaaaaatgtgcgatgagttaattgacgcacatggagattatatgaagatgtataaatagtgataaagtttcgcattgacttgacggaaatcgggtatcggcttataatcaaattcacctgaaaaaggcagttggaggaatatgattatggcaatgaatccagtaaagttaatgcagataaaagcgacaattgccggagtagagaggcggcatccgaatcttcgaaagttttttgaggcagttggaagagaaaaattaagagaaggaacgattttggaactgaaggtgcagacaccggaagggaaaaagctgatttccaatgtaaaactgaccaaagaagatgaaaaattaatttcagagctgttaaagaataaagacaccttgctttaaaaaagcaccttgcttaaaaagcagggtgtttttttcttgacaaaggtaagaattgggagtaatataatgctaaaatgttcacgaaaattaaaaaggtggattacatgaatatacaagaatatgatattatgaacgaaatcgcagaaagcggttatgaaaatcagagaattttaacagaaaagacaggatattctcttggaaaggttaatcagtccttaaatgaattgattcagaaagagtatcttaccaaagaatatcaattaacagaaaaagcagaagcggagtttgaaaagaaagctccgaaaaatgcaattattttggcagcaggttatggaatccgaatgatgccgatgaatcgggaagtgccaaaggggttaatcgaggttaatggagaaccgttgattgagcgcctgattcgccagcttcatgaagccggaatttttcagattgatattattgtcgggtttatgaaagagcagtatgaatatctgattgatgaatatcaggtgaatctgattgtcaatcgtgaatatgcccagtacaataatcttcattctctggcacttgcaaaagacaggatttcaaatacatatattattccgtgtgacgtctggtgtgaaaaaaatccattttccaaaagagagctgtattcctggtacatggtgacagatttggtggatgacgaaagtgatgtcagagtcaatcgaaaattagagctggtttcggtagatgcagaaaaaagcggaaatgcaatggtaggcattgcttatatccttgaagaagaagcagaagaacttcagagccagataaaagaaatgtgtaagaaaaaagcttatgaaaacgtattctgggaaagcgctctaatgaaaaaaggtaaaatgtatgtatcagcgaaaatcgtgccgtcaagaagtgtttatgagattaatacttatgagcagttaagggaactcgatgacacgtcaaaacagttagactcagatgtgattcatttgatttctgaaattttggcatgtgagccgaatgaattagaagagattgaagttctaaaaaaaggcatgacaaatcgttcttttatgttcaagtgcagaggcaaacggtttatcatgaggattccgggtgagggaacagaaatgctgattaaccgaaagcaggaatatgaagtttatcaggtaatcaaaccgcttggtatctgtgattcgattcgatatatcaatccggaaaatggttacaaactgacagaatttatcgaagatgcaagatgctgtgattccggaaacccggaggatgtaaaagcatgtatggcggtgctccgtaagtttcatgaaagcggggtaaaggtggaacacacctttgatgtttttgaacggttggagttttatgaaaaattgtggaagggaattccgtcctgctatcgtgattacaagcaaaccaaagcgcatgtatatgaattaaaaaactatattgataagcaggaaaagcagatttcactgtgtcatattgattctgttccggataactttttaatgaccaaagacagaatcgcattaattgactgggaatatgcagggatgcaggatacagatgtggatcttgcgatgtttatcatttattccatgtacgggaaagaacaggcagatgctttgattgatgcatattacacagaaggatgcaaaaaagaaaaacgattaaagatttactgttacgttgcagtctgtggtctgttgtggagtaactggtgcgaagtaaaataccatgaaggtgttgaatttggcgagtattccttaagacagtaccgatacgcaaaagaatattataaatatgtaaaggaagaactggaaaatggcttataaagtagaaaatgcagttattatggcagcaggattgtccagtcggtttgcccctctttcttatgaaaaaccaaaagcgctgattacagtcaaaggtgaggtgctgatcgaacggcagattcgccagttaaaagaggccggaatccatgatattgcaattgttacgggatataaaaaagaaaaatttgaatacttaaaagaaaagtgtcaggtgacacttatcgaaaatccagagtatgcaaccagaaataataatggttcgatttattcggcaagagaatggattgggaatacttacgtgtgcagtgcagataattatttccctgaaaatccatttgaatcggaagtagaaggcagttattattcggtactttatgccgatggggagacgaatgagtggtgcgttacagaagatgaaaccggaaggattacttcggttaaagtcggaggcagagactcctggtatatgatgggacataccttctgggcagagccgtttagcaaacgcttttttgaaatcttagaagccgagtataacaaaccggaaaccaggaataaattatgggaagatatttatattgaacatatcgaagaactctcgatgaaaaccagaaaatataatcaagatgaaatttatgaatttgattctttagatgaattaagggagtttgatgagaactataaaacaaattccggttcagaaattttaaaacaaatttcggaagaacttcagataaaagaaggcgaaattaaacagcttgttccggcaaaagatgagaatggactggtaaccggagttaagtttgaaatacaaggaaaacagtttgagtatgactatcagctgaaaaagctgatacatggaggaaaaatcaatgaataaattagatcgcaaaagaatagactggctcatcacgttagctccttttattagcattatgttattagcgggtgtattatttgtatttccaaatgagtccaataacattataagtaaggtgcgattttttttcggtgatacagtcgggatttattatttagtaattggtttggcagttttgctggtttctgtttatttagctttttcaaagtatgggaatgtcgtattaggcgagccaaatgagaaaccgaaatattcattttttgtatggggaagcatgatgtttacttgtggacttgcagcagacattttgttctattcatttgcagaatgggtaatgtacgcaactaatccgcatatggaagaacttggctccgtggcagaatgggccggcgtttttccattgtttcattggagctttattccgtgggcattttatctggtacttgcagtcgtattcggttttatgttacacgtgagaaaaagaaatcgtcagagatattcggaagcatgtcgaccagttattgggaaacatgcggatggtgtgttgggacgtgtgattgacttatttgcattatttgcgctgcttgccggaaccgcaacgacatttagtgttgcaacaccgcttttggcagcaattattgtaaagctatttggtatcacgcttagccgaacagttgttacaatcatcattttattggttacctgtgcagtatatacttatgcagttttgcatgggtttaaaggaattagttttttggcgaagctgtgtatttatcttttctttggcttattattgatcgtgttgctaatcggtggtcaggggaaatttatcattgaaaatggcttccaaagttttggaaagatgttacagcattttatagagttaagcacatttacggatccggaacgcaccagtaatttcccgcaagattggacgatttattattgggcctattggatggtttgggcagtcgcagctccattctttattggtaacatttcacgtggcagaacgattaaacaaacgattcttggaggatatgtgtttggtgttggatcaacaattattagttttgtcgtacttggaaattatgggcttgggcttcaagtgagtggaaaagcagattttatttcccaatatgcgaaagatggagatctttacggactcattttgaatattatagatacaatgccgctggcaaaggtgattttagtaatcacagtgttatgtatgattgcattttatgcgacttcatttgattcgattgcatatacggcagcttgttatagttacaaggagcttggagaaaatgagcatccgcataaactgattgaattattatggtgtttactattgattgtactgccgattgcgttagtgttttcggaaagttcgatgaataacattcagagtatcagtatcatttcggcatttccgattggcattattatgattcttattttgataagtttctttaaagatgcaggaaaatatttagctgaatcaagtaaatctcctgattcaactacgaaaagcaagaagtagtgggtagagacttgctttttgtagagaacggtaaagaactggagaatttgatatgacacttatacagttaaaatatattttgacaatagcagaaacaaaatccctaaataaagcggcagagcagctttatgtttcacagccttctctaaccaatgctctgaaggaactggaaaaagaaattgggattacgattttttttagaagtggacgtggtgtaacactgacgaatgatggcgtggaatttttaacctatgccagagagctttatcatgagtatgaacagttactgcaccgttatacagaaggcagttcttataagaagaaattcgcagtttccacccagcattattcctttgcggtcaaagcgtttgtggacgttgcaaagacgctggatatgtcacagtatgaacttgcaatccgtgaaacaaagactgcagaagttattatggatgtcagcacaatgaaaagtgaaatcggggtattatatttaagtgactttaaccgcaaatccatggaaaaactcttaaactctgcaaatctggaatttcatcccttaattgagtgtgatgcttatgtttatttatggaagggacatccgttagcggaagaagcatgtattacgatgaagcagttagagaattatccatgtctggcatttgagcagggagacaacagttccttttatctttcagaagaattactgccgacaaatgaatacagtcagattattcatgcaaatgacagagcgacgatgctgaatttgatggtgggcttaaatggttatacgctttgttccggtctaatctgtgaagatttaaatggaaatgactatcgtgcagtaccgtttaaaaatagtgaaggaccggaagaaaacaaaatggaagtcggatatgtgacaagaaagaatctgattttaagtaaattaggtgagatgtacgtaaatgcattaaaagaatatctgaaaacggaataacgaaaggaatcatgaaatagccagttatagttttaaactataactggctattctttttgtgtattagacaggtggtttttgttatgttaatatcaatggcatgtaaaacatattaaacaggtatgaaaataggaatataaaaacaggaggaaaaacagatgacggatgttctgattattggaagtggtccggccggtatgacagcaggcatttacataaaaagagcaaacttagatgtgcagataatagaaaaagaatatgaaggaaccggtcagatggcagagagcagccgcattgataattatcctggattttatggaataagcggttatgacctgggagagaaaatcagggagcatgccgaaaatttagagattgaatttttagaagaagaagcagttgcctttgaagagaccaaaaaaggatttttggttatcctggaaagtggaaaaacactggaggcaaaaacagtgatttatacagccggagcagaacacagaaaattaaatgttcctggaagtgatacatttgaaaataaaggaatttcctattgtgcctcttgcgacggagctttttacaaagaaaaagacgtggtggtgattggtggaggaaacagtgcattggatgatgctttgttactttctgaaatttgtaacaaagtatatctggttcacagaagagataagtttcgaggcaatcctggaacacttgcaaaattagaagcaaaagagaatgttgaaattattcgaaatgcaaatgtccaggaaatcaaaggaacaaaaaaagtagaaactgttttgttagatacaggagcttcccttgaagtacaaggtgtgtttgtagcagtggggatgattccacagacagaaaaattaaaagacctggttgagttagatgaaaatggatatgtaaaagctggggaagatggaatgacttccaaaccgggattttttgtagcaggagatgtaagagcaaagaaacttcgacagattattacagcagcagcagatggagcaaacgcagcagattcagccattcattatatcatatagtagtacaacgtacgaatagaaaggaaacaatatcatggtaaatcaactgacaagagaaaattttgaaaaagtaataaaagaaaacagtattgttgttgtagagttctattctgcaacttgtaagcactgtaaaaagctggaggcaggaattgcagagctttccgaggaagccggaaatgaagtgtacttcggaaaagtattagtttctgatgaactggctctggcagacgaatatgaaatcacctcagttccgactttattatattttaaagacggagagattcgtgaaaaatcaattggctttacacataaactgattattgcagaaaacataaagaaattataaaagaacaggagtagatagattatgggatatccaagtatttttccaacaggaacattaatttatgataaagagaaaacatttaatggttatacgatttttccttccgcaaaaggagcattattaatcgatatgaatggtcgtgaagttcagctttgggcaggacttggcggatttccaaataaaattcttccaggcggatatgtaatgggaacaacaggaacaagacctggtaaaaaagcgtatcaggaccagattgatttggttcaggttgactgggatggaaatattgtctggaaatttgataaaacagaattgattgcagacggagataaagacccggtttacatggcaagacagcatcatgattatcaaagagaaggctctactgttggttattattatccgggcggagaaccaaagacagatagtggaaataccttaattttaacacatgaaaatctttacaatcatgatatttcagataaacgtctgattgatgacaagattatcgaagtagactgggaaggaaacatcttatggagctggagagcaagcgaccatttcgaccagttaggatttgatgaggcagcaaaaaatgcactgtttcgtaatccatgcctgcaaggtgaagccggtggtgactggatgcacatcaacagcatgtcagtcttaggtgaaaataaatggtacgaccagggagatgagcgtttccatccggacaacctgattattgatgcaagaaatgcaaatattctggcaatcatcagcaaagaaaccggagatatcgtatggcgtgtcggaccagattttaatgaaaacgaagcaaccaaaaaacttggctggattatcggacagcaccatttacatatgattccaaaaggacttccgggagaaggaaatctgctggtatttgacaatggtggagaaggcggatacggtactccaaaccctggagcattaacaggtgtcaacaatgcaaggagagattattcaagagtacttgaatttaacccgattacacttgagattgtatggcagtatactccacttgaagcaggaaatctgttatttacggatgcatctaaattttatagttcctacatcagtgcagcacagagacttccaaatggaaatactttaattacagaaggttctgacggacgtctcattgaagtgacaccggaacatgaaattgtatgggaatacattaatccatactttaataccatccttggacagtttacgaacaacatggtttaccgtgcataccgtgtaccttatgaatggattccacaggtagaaaaaccggaagaaatttctgttgaaccgattgatgtggaaaccttccgtgtgccgggttctttagttggaaatggacttggaaaagttaccacaatcgacggagtagacccagaagcacgcctgatgacaggtggcggagcctccgatgacgaagatgaagaagtgaacttctgtgtggcaaccgtaaagaaaagcgatttaattcataaataaatttaaggtcatgatacctgaaagggagtgaagaaaatgaaaagcaaaaaaattacagcagcagtttttggtcttgttcttacattaggtctggtggttacaggctgtggaagtaatagtagtaaagcagatgacggtgcgaagacggattcaggaagcaagaaagaagcaaatgcagatggatatcaggtagtcaatatcggtttcccgagtgccggttatgaatgggcagaaggtgcactggcaatagcagaagaaaaaggttatttggatgaatacttaaatccacttggatatgatgcagatttgattccatttacaggagctgcaccggcgattcatgaagctttggtatccggagatttggattatgcatattatgcaggatttgcaggaattatggcaaaatcaaatggaattgatacaaagttattggctgtaacaagctttggatctgcatggcagttagcggtcagcgcagattccggaatcacttccttagaggatttaaaaggaaagaccatttcctatcaaagaggtgcaactcctcagatgtatgtattaaaggtattagaagaagcaggtcttagtgcggatgatgtacagcttgtaaacagcacaattcctgaaggactttccagtctttctaccggtgcagttgatgcggcagttgttacttatggacaggcagataccttagtagaacagggaaaagcttctattattcataaaggggtagatgcagacgcagatacgttctatgaaccaagcgtgttaacaggaagaacagattttgtggaaaaaaatgcagatgtctcaagcgcaattattgaagctatgttaaaagcaagagatgatactattgcagacccggaagcattttacgaattgtcttctgaaaagagcggaagaacattagagcaggtgaaatctgtagccgtatctgatgtaaaacttgcttatccggtcagtctggatgaaagatatattacttcattaaaaaatattgagcagtttgaacttgataacgatattattaccagtcaggtagattttgattcctggattgattcctcctatctggaaaaggcagtgcaggactatcagggaaacgcacagtagggaggatacatgagcatgtacaaaggaaataacgtatttatacaaaaattattgctctttcttaatatgattatattgccggtactgattgtactggcatggcattttgccacttctaccggagcaatgtccacactgattctgccaaaaatcagtaccgtgcttgagacattgaaagaccagcttacaaatggtccgcttgccggagatatcggcattagtttaagccgtattgcaaaaggatatgcgctggcagttgtggtaggaattttacttggcgtgctcatgggaatgaacaaatttgcaaaccgttttttcatgctgacatttacagcgattcgtcaaattccaatgattgcatgggttccgattttaattatctggtttggtatcggagaagaatctaaagtagcagttatcttcttagccgcttatttcccggtactggtaaataccgtcagtggtattgaacgtacagacccgaaattgattgaagttggaaaaatgtatcatttaaatggatggcagcagtttacacagatttatcttccatctgctcttccttccatctttgtaggattaaaactgggattaagtgtatcctggatggcagtagtcggtgcagaaatgattgcagccacatctggtatcggattccgtatcaatgatgcaagaagcctgatgcagtatccgattgtatttgcaggaattatcgccattgcagtggttggtgtgattatggatttggccatctcactcattggtaagttatgcacaccttgggaaagaagcaggtaggaacatgggaaagaaaaagttaatcgttcatgatgtaaataaaagctttgtagttaatggacaaagcgtagatgtattaaaagatattaatcttgaaatagaagaaggcgaatttgtagtcatcgttggacacagtggatgtggaaaaagtacgttattgaaaatgattgcaggacttgagaaaaatgatacaggaattttaagtgtagatggaaaagaaatcgatggaccaggaatggacagaggaatgattttccaggaacatagattatttccatggatgagtatcgagaaaaatgtacagcttggtctaaaggggctgagcaaagaagaaaaaagaaaactttctgaccagtatctggagctggtaaagcttagtgaatttaaaaaagcatatccaagtcagctctcaggtggaatgtcacaaagagctgctattgcaaggtctttagtcagtcagccagaaattcttctcttagatgaaccatttggagcattggatgcgctgacaaagattgaacttcaggaagaaatgctcaagattcgagaacgctttcataataccatgattatggttacacatgatattgaagaagccgtatttctagcagaccgtatcgtggttatgtccgcaagaccgggacgaatcaaagatgtaatcaaggtagagcttggaaaatacagggaccgtggaagcacagacttcacacattataaaaagaaaatctttgattatttctttgaagaaaaaacagttacaccagaatacaatatttaaaaataaaccatgtagatgcctgagaaggatttacatggttttttgatttttggaaaaatgtgtaaaatcacgtcaaaaaagctggaaaaatgtgaaaaaaacaagaaaaaaattcggaaaaatgtgtaaaaatggatttgaaaagccggaaaaatgtattagcattaatatagaatgaatttaaaaggcggtggttttcaatgaaaagaaatgcaatgcaggatttagtacaatggaaaaacgatgaagaacggaaaccaatggtattaaagggagcaagacaggttggaaagacctggattatgaaagaatttggcaggcagtattatgagagttatgtatatttcaactttgatgaagaggaagagttaaaatccatttttgaaaccaataagaatccgtaccgcattattgaattgctatctataataattatttgattattgggggaatgccggaatgtgtagtttcctggataaaatataaagacccagccagagtttcgaggattcaaaaagagttaattgaagtttatgagaacgacttttcaaaacataatggaaaagtaaatagtggacggattctcatggtatttcgcagtattgtttctcagcttgcaaaatcaaatgaaaaattcatgtatagtgcagttcgtgagggtgcaagagcacgtgattttgaagaagcgattgaatggttagtatcagcaggtatggtgaatcgtatttataatgtgtctaaaatggagcatccactttcagcttttaatcgtttggaccagtttaaattatttgtattcgatacagggttattaaagtatatggcagggattgacaacagtgcgattttattaaattccagttatcagtttaaaggagcattgacggaaaattatatacttcagcagcttcatggtcagtttgaagttgaaccgcactatttttcttataagaatcaggagattgattttgtacttcagaatggaaattgttcctgttgaagtaaaaggcggtgaagataagtcagcgccgtcatttaaaaagtatgttcaggaaaaagaaccgaaaacagcgttgagattttcaaaaagaggatatcggaaagatggaaatgtcacgaatgtgccgttgtatctggcaaggaaaataagagagttgatgtgaaaagatgagtatgataatataaagtaaaatttggtgatgaaggtaggaattaaaaaatgtgttatctaattgctaaagacagagatgtgcatggatgcttcgcattaaaaacaaaacatggaaaacatttagcagaattaaaaagagaattaaatgaagcagttggctataaaggagttcagttagtaacaattagcagaccaacagcttatggagaatatgcaccgtattgttttgtggatacagagaaagagtttgaaactcttgtaaagtcattgcgttgatgaaaaatgtattaacgagaaaaccagccaatatacggctggttttttagtaaattattaaatggcaactttaaacattgctttctttattcgttctggtttctcaggagcaattcccgggcgatgagcatctgttggataacagataagaaaatcattctcttttaagaaaatcgttccatttgctgttccggagaacgtctcaaagtcatttgcctcgagatagttaagaggcttcatatttggtgtaaagttcacgtcgatttgttctgcaccttttaagatgaaatgaatatcaagaaatcttctatgagcttcccagcctttttcttctacagggacagtttcaaattccataatatttagatagacattatcgccatcaatttcgtaatgaccacagggaaaagaagcaaggtcgttattttttgcataatttaaacattttgcaatgccatctgcaaaatgagaaatatcgtttggtgtaaggttattaagattgtcgaaatacataaagagtccttctttcttttaaatttgtatgttatgctgttttaaagtattacgcaaaatagttgccatgatatcatagccttttccatttggatgaagaccatcataagtaatgccgtctaaaggaatactggcccccggatagcaggtaggggtatagtagttaacaaaaataagtccttcttgtcttgctttttgggtaagccagttattaaaatcttttataaaatcttttcgttccctttcatgtaaagaagttggcatgtaaattggcattaaagaagtaatgattaattgagtactggtttgttttgcctgatagataatgtcacagtaattttcttttgctttttcgagcacggcatcgtatggagcaggaggaattaatttccaataatctccctccaaattaattgtgtcattaattccgatgtccaaaatacaatatttcggttcaagctgtaaaacatcggtaaaaaaacgttttcttaaataagttgtgttgtctcccgcaattccccggttgataataaacaggttaggatttctgaaatatgcattgagttcccaaaaatgtgtaatggaatctcctgcaaaaatgaaatccggcttttgatttgagtacattaaagaatgatttttaatattaaattctttctggcggctgtcagcagccacaacttcagaatagtatccggcattgtgatttgacatatcagaacctccaaaagtaataatcttaagactgattatataatgaagaatcaatagaaaaaatggaatagacacttaataatagcataatgctgtcaaaaaacaatatttttgtattgattatagcttaggataagactatcatataagaggaggtgatttttttgaaacagggtgtggataatgtaaggtttaattttctttatgtggataaatattcttttggcagaacgtgggtctatccggagagtattgttccatacaatatgttaaggtatattcgctcgggtgcggctacattttttattgatgacaaggaaatatcggtagaaaagaatcagattatatatgttccgagaaattgtaaattgtcttgttatgcccaaacggataacttttcttttataagtatacgatttaccacatctgtattttttgaaggtggagattttctggcagattattacggagtaccattggtaacagaagcaaaaggcgaggaaaaatattttgacctgatttatgattatattaaaagtgaaaatccagccagaatttattttgtcagaggttatttggaaattttaattggaactttgatatccagagcagatgcagataactatggaatattaagaagaaacaagacggatgaggaatatactttggaaaaagtgagacagagaatccgtaaatcagataatcggattgattcgagaatacaggttgttgtagattatattgcacttcatcctacggaacactatacaccggagagtatggcaaagatggcggagttaagtaaacaaagatttagtcatttatttaaagagcaacttggaaaagcaccgatgacatatttaaaagagctacgtttaacaacagcggccagaaagcttttagtaacaaatgataatattagtgatatcgcatatagcgtggggtatgaagacccgaattattttacgagagaatttaaacacgcatttggatatacaccaaatcaataccgaaaagcagcgagagattagcatcaaagaatgagcgtattatgctattaatgcgacacgattgcggaaatgataagcttagtggagaaaaattgattaaaaaaaggcagtacagactagaaaaaacgtgactaatagaataaaaaacaactgaaacagcggagattgtagcaaaggtgatactttttaagcaggttgaaaagtaccaccttttaatgttgaaaaacgagcgtattgtgctattaataggttagagcttcattgaaaacgcctaaaaaaatacttataatgacaacataaacagcaatatgacgaaaaggacagagcatattgtaatggggctaggaaaaacaatttaaaaatcaccaaaatgagaagagtgaaaggagaacaatatgaaaaaaagactagcgatgctattggcgggagtaatgttgaccggcagtttattaacaggatgtggaggggattcatcagcgagtgatacaaactcagatgcaaaaaaagaagcatctaattcagatgaaactggagaattagagggcgacatcacattttggcattcctttacacaaggaccgagacttgagacaattcaaaaagcagctgataaatttatggaagaaaatccaaaagttaatattaaaattgaaacattttcatggaatgacttttatacaaaatggacaacaggtcttgcttccggaaatgtaccagatatgagtaccgcacttgttggacaggttgctgaaatgatcgattccgatgcaattattcctttaaatgatttgattgatgatattgggcgtgataaattccaggaaaatgcattaaatgaattaacagtagatggaaataattatgcagttccattatattcacatgcaatggtaatgtgggttagaaaagatttacttgaagcaaataatatggaagttccaacaacttgggatgagctgtatgaagatgcgaaggctttaacaaaagatggaatttatggattatctttcccatgtggaacaacagatttccaagcaacaaacttcttaaacttctatgttaagagtggaggcggaagccttttaacagatgatttaaaagctgacttgacaagtgatttagcaattgatggtattaattactggttaaaagtatacgaagactgttcaccgaaagattctattaactacgatgtattagaccaggcaaccttgtactatcagggaaaaacagcgtttgattttaactctggattccagattagcggtgttgaggcaaactcaccggatttattacagtatgtagactgctatccaattccaacaattaataaaggcgatgagcagaacggtattacaacttctaaccagccaatggttgtttggaaaaattcaaaacatcctgaaatttgtgaagcgtttattgaaacattatatgatgaagatacttatgttgaatttcttcatgcaacacctgtaggtatgttacctgcaattaaaggtatttctgatacagatgcgtataaagataatgacatgattaaacagtttgaacatgcagaatccgtaattgaaagtcagattccaggaggaacagcaattggatttgaacatggtccaagcactcaggctggcatcttaacaaatcagcatatcattgaaaagatgttccaggatattatcacaaacggaacagatgtagaagaagcagcgcaggcagcagaagatgaattaaatgctttatttgaagcagttcagtaagcatcgactgtattaacattataaagcaggaaatactttaaaattcctgctttataatttgaagagggtgaataaacaagatgaataaaaaaaattatactagatggctatttgtgcttcctgcgattatcattgttttggctttgtttgtatatccaattatatcaagcttttattttagttttacaaataagaatctgattcggcctacttatgattttgttggactcgataattatatagcagtattaaaagataaaggcttttggaatgcttttctcaattctttaaaatggacaattttttcacttggcggtcagttgcttgtaggatttacagcagctttggcacttaataaagtaaaacacttaaaaggtttttataaaacattattaattatcccatgggcgtttccatctattgttattgcgttttcatggcagtggattttaaatggggtatacggatttttaccgaacattcttgtacaacttggtctgtgtgatacgccgccacagtttttaacagatagagtgttggcgtttgtggttttagtatttattaatatttggtttggtgctccaatgattatggtaaatgttttagcagctttacagactgttccacaagaccagtatgaagcggcggaaatcgatggagcaaaaggatggcagtcattcttatatattaccgtccctcacattaaggttgtaactggattattagtagttcttagaacagtgtggattttcaataactttgatttgatttatctgattacaggtggcggacctgctggtgctactcagacagttccggtttatgcttatgatatgggatggggaacaaaattacttggaaaatcatcagcagtaacagtgctgttatttatattcctgatggctgtatgtgttgcttattttgcagttcttgcacattgggaaaaggaggataaatagatgaaacataaaggacaaaaaatacaaagctttatctgtcatttttatctgattattcttacgattattgcaattttcccattggtatggattatattatcttccataaaaggaaaaggtgagttaacaggaaatccaaccggatttttaccaaagacatttacattggaatatttcagacatgttatttttgacttgggattcattaataatattaaaaatagtgcaggaattgcacttgtaacaacattgattgcaattattgttgcagctttggcagcttatggtattgtaagattttttcctaaatttggaagtgtaatgtctaaagtgcttgtaacaacttatattttcccaccaattttattggcaattccatattcaattgttatggctaaggcagggttggtaaatacaagaattggtttgattattgtatatttatctttcagtattccatatgcggtatggcttcttgtgggattctttaaaagtgttccgattgggattgaagaagctgcaagaattgatggagcaaataaaattaaagtatttggaacagttgtacttccattggttgctcctggtattgtagcaaccgcaatttatacattcatcaatgcatggaatgaatttttgtattcattaattttgattaatgatacttctaagatgacagttggtgtggcacttcgttctttgaatggttcagagattcttgactggggagatatgatggcggcatctgtaattgtagtaatcccttcaatcattttcttctgtttaattcaaaacaagattgcaggtggcttaacagaaggttctgttaaataaaaaagaactaaaaacaacaatataaatcaaaaaaggagaagaaaaattatgaattacggtgtagttggagttggatattttggtgcagagctggcacgcattatgaaacagaatgaggatgcaaatattgtagctgtttatgacccagataatggaaagacaatcgcagaagaacttggatgtgatgcaacagagtctttgaatgaactggtaacaagagatgatattgattgtgttattgtagcaactccaaattatctgcataaagagccggttattgaggctgcaaaacatggaaaacatgttttctgtgaaaaaccaattgcattaagttatcaggattgtgatgaaatggttcgtacctgtgaagaaaataatgtaactttcatggcaggtcatgtaatgaatttcttcaatggcgtacatcatgcaaaagaattaattaaaaatggtgtgattggtgatgttttatactgccattctgcacgtaatggatgggaagatattcagccgagtgtttcatggaaaaaaattcgtgaaaaatctggagggcatttataccaccacattcacgaattagactgtgtacagtttattatgggagaaatgcctgaaacagtttatatgaacgcagataacgttgcacatagaggagaagcttttggtgatgaagatgatatgatttttattaacatgaagttttcaaatcatagatatgcagtattagaatggggttctgcattccactggccagagcattatctgttaattcagggaacaaaaggtgcaattaagctggatatgtttgatgcaggtggaactcttaaagtagatggaaaagaaacacatttcctgctgcacgaaagtcaggaagaagatgatgatagaacaagaatttatcatggaacagagatggacggagcaatccagtatggtaaaccaggtaaaaaacctccaatgtggttacatggtatcatggtaaaagaaatgaaatacttaaatgatattatgcatggaatggaaccagatgatgaattcagaccactgttaacaggagaagcagcgagagccgcaattgcaacagcagatgcttgcacaaaatcaagtgcagagggaagagttgtaaaggtaagtgaaattttgaataagtaatttaagatgatttttgactagtctaaagatgcaacaatagtgagcaagtaaattgagattcatattagaacatctttagactaaatttatattagatataaatctagaacatggaagaatgtttcaaaataaaaaatatgggtcgttaaattaaaacacggcagaatggagacaaatgaatagaaaattagtagcattatttttaagtcttgttatgagtatgtctacagccacagtttatgcagaacctacaaatgaagagacgcttcaaaaagaaaacattgagaatgtacaagaagataaaatatacaaaatggattggtatttgaacaaaataatattgatatagtgcagggacaagggtatgatgttagttctgaagaaggagcagagtatgtggaagccctatcggagggaacaattattatttctttcaaatcaaccagtcaaaatcaatatcagtcgttaatcagtataggaaacaatagaacgggaaatcaaaatagacattttcatctgtatataactaatacaggtgcagtaggaatggaattaagaaatacggattctgtatttaaatataccttaagtcgaccagcagctttgcgttctaaatataaaaatgagtatgtatcaaacactgttgcatttaaagctgatagagaaaatcatcaatataaattatttgcaaatggtgagttgcttgcaacattggacaaagaagattttaaatttataagtgatattacagaagtgaataatgtaatgttaggaggaacaaatagacaaggtacagtagcatatccgtttggtggaacgattaatagtgcgcagatatatcagagcgtattgagcgatgaagagttaaaagatattactggcgtcacaacttatggtaaaaatattttttatgaaggagacgctacaaattcaagctattttagaattccaaccatgcttactttaaaaaatggtcatgttgtaacttctattgatgtaagatatggaggaacacatgatgcaagaagtaatattgatattggattttcaaaaagtgtagatgcaggagaaacttggagtgaaccgactatgccaatgtgttttgacgactatgcagctgaacagattgactggccaagagattcagtaggaaaaaatgtccagataaatggaagtgcagcgtttattgattcaattcttatggaggatcaggagacaaatagactatttttatttgctgatgtagacccagctggaataggatttaataacagtagtgctggttcaggatttaaaacaattaataatgagaaatatgttgcattacgttggagcgaagataattctaatacttataattattctattagagatgatggagtgatttatgatgatacaacaaatcagccaacggaatattcagttgatggtaattataatatcttgaaaaatggagagtatttaacccaaaaacagtatcaagtaagatttgagggaactacattgattgaagaacataatgatgtggatgttaaacaaaatgtattctataaagattctgtttttaaagttaaacctgtcaattttgtaggaatgaagtacagtgatgacgagggtgaaacatggtcggatatgacattgttaggaaagtttaaaggggataatgaaagggttcctctttttggtccaggcgttggtgtacagataaaaaatggcgaacatgcaggcagacttattttaacaatgtataatagcaggtcggcagaattcggatttctctatagtgatgaccatggagcaaactgggaatattcgactacagatttaggtggaaacggaacatttgcagaagcgcagatagtagaacttccagatggaacattacaatcttatatgagaacaagtgtaggtaagataggagttataaccagtattgatggaggcacaacttggacaactcaatcgtatgtggatggaatgacagcagcatcgtatggaacacaattatctgtaataccgtattctggattagtagatggaaaaccagctattcttttatctgcaccaatggcaacaaatggaagaagaaatggtaagatatggataggtttaatcaatgatacaggaaaagaaggatatgataaatacgatattgaatggaaatattgctattctgtggacgatgacaaatatggattttcatatagttgtttatcagaaatgccagatggacaagttggaattttttatgaaaaatatgattcatggtcaagagatgaattgcatctgaaaaatattatgaagtttgaaaaatatacaattgatgagttaaaacaggaagttaagtaaataaagcaaaggagtttgtgatttggtaagtcacaaactcctattttggattaagtgttaaagaaaattatttatcaatcttactcagtgctgcttcatctgcaacgattgttacatcattatgtaactgcagaatagaagcaggaacttctggagtaattggcccgtaaagcacttcttttaagatgtctgctttatctgcaccacttacaacaacgaggattttctttgcctgcataatgtttttaatacccattgtataagcttgtttcggaacatcatcttcggattcaaagaagcgtttatttgcttcgattgtactttctgtcaagtctacgcagtgagtttctttttcaaatgcttcacctggttcattgaatccaatgtgtccgttatgtccaagaccaagaagttgtagatcaattggccctttttcctgaatgatttgattgtaatcattgcaggctttctgggaatccggttcaagtccgtttggtacaaaggtatgagtcttgtcaatgtttacgtggtcgaagagattggtattcatgaagtagcggtagctctggtcgttttctggacttaaacctttgtattcatccagattaatacttgttacctgtgaaaaatctaaatctcctttttcgtaccattcaatcaactgtctataagttccaactggtgaagaaccagttgccagtccaagtacacagtttggtttcatgatgatttgtgcggagataatatttgcagcttttctgctcatatcctgatagttttttgctttatagatattcatatctataccccttttcttttttgtaataattgtgtttttagctgtatttctgagtattagtataagaaatttcaggatgattttcaataaaatagggagaagttgggagtaaattagccattttggaacgataatcctattattgtacaaaattgctaaaaataaagcggtacaactaagagaaacatggataaaagtgaaaaactttgaaactaatttcataataaaacaactatattgaaaaaagtttcaaaaagaactatactttggacataacaaaggaggtcaaaaaaggatgaatcaaaaagtagaaaatctgaaaggaaaattaattgtatcttgtcaggcacttccacatgaaccgttacattcttcttttattatgggaagaatggcattggcagcgaaagagggcggagcaaaaggaatccgtgcaaatacaaaagaggatattaaagaaattcagtcacaggtagaccttccgattatcggtattgtaaagagagattatgatgacagtaaaatttacatcacacctacaatgaaagaaattgatgagttaatggaagtaaaaccggagattattgcaatggatgcaacgatttctacaagaccaggaaataaaacattagataaatttttccatgaggtgaaagaaaagtatccagaccagctttttatggcagattgttcaacggtagaagaagcacttcatgcagatgaacttggatttgattttattggtacgacaatggtaggttataccgaacagagtaagggtgataagattgaggcaaatgattttgaaattttaagaaaaattcttgcgagtgcaaaacacaaagtaatcgcagagggaaatattaatacacctgaaaaagcgagaagagtaatcgaactcggagcatatagtgttgtagttggttcgattatcacaagacctcagttgattacaaaatcatttgtagaagaaatggaacgataatatttataaattagagaatagaacaaaaaagcgaggagaaaaagctatgagaaatcttgaaaagtacaaaggtgtgattcctgcattttatgcatgctatgatgaagagggaaatgtaagtccagagggtgttcgtgcgttaacaaaatattttgtagaaaaaggcgtgaaaggtgtttacgtaaatggctcttcaggagaatgtatttatcagagtgtggaagacagaaaaattattctggaaaatgtaatgaaagcagcagagggaaaattgacagtcattgcacatgttgcctgcaataatacaaaagaaagtcaggaacttgcaaagcatgcagaaagtcttggagttgatgcaatcgcagcaatccctccaatttatttccacctgccggaatatgcaatcgcaaaatactggaatgatatcagcgaagctgctccaaatacagattttgtaatctataacattcctcagcttgcaggagttgccctgacacagtccttgtttacggagatgagaaaaaatccgcgtgtgattggtgtaaaaaactcctctatgccagttcaggatattcagatgtttaaagcagcaggcggagaagattatgttatctttaatggtccggatgaacaatttatgagtggacgtgtaattggagcagagggagcaatcggtggaacttatggagctatgccagaattatatttgaaactggatgaatatgtaaaagccggagaaatggaaaaggcaagagagcttcagtatgcatgcaatgaagtaatttacaaaatgtgttctgctcatggaaatatgtatgcagtgattaaagcaattttaaaaattaatgaaagtctggaacttggcggagtaagagagccactgccatcattaattgaagaagatatggaaattgtaaaaagagcagcgcagatgattcgtgatgcgaaagcaaaatatttataagtaaaatagttatttaagtagaaacacaatagaaaatacagaaaaaagagaaaggggcagaccgaaaagaaaggtttgtcccttttggggtatttggttataaagaagcggtaaaacggatggcttgagaaagtgtaagaaagtgtatataataaaaggaaagcataagaggaaaaaagagatgaaacagtacataagtattgatattggtggaacagcaattaaatatggtgtgattgatgaaaatgcacagattttaataaaaaaatctatggaaacagaagcctttaagggtggtcctgagattcttaagaaagcaattggaattgtagagaaattaatgaaggaaacaaaattagaaatttctggtatttgtatttcaacagcaggaatggtagatatcgaaaaaggttctattttctattcggctccattaattccgaattatgcgggaactcaatttaaagaagttctggaagaaaaatttaaaattccatgtgaagtggaaaatgatgtaaactgtgcaggacttgcagaatatcaatctggcgtagcaaagggaagccacgttgctgtgatgttgacaatcggaacaggaattggtggctgtatcattttagatggaaaaatctttcatggtttcagtaacagtgcgtgtgaagtaggttatatgcatctggatggcggagaatttcaggatttgggagcggccagtattttgacaaaaaaagttgccaaaagaaaacaggagtcagaatcagactggaatggatatcatatttttgagtcggcaaaacagggagacgaaacctgtattcaggcgattgatgaaatggcggatgtattgggaaagggaatttcaaatatttgttatgtactgaatccagaaattgttgtactgggaggcggaattatggcgcaggaagaatttcttggagaccgtattaagcaggcggtaaagaagtatctggtatcaagtattgaagtaaatacgacaattgcatttgcaaaacatcaaaataatgcgggaatgttaggggcgttttatcatttctgtggagtacataaaaaagaatagtgcataagaagaataggatgaagaaatgggatattatgtgaaatcagtagtgccggtaattgaatcgaattatgataagtttacgacagtagaaaaaacaatagcggatttttttattcaaaataaagagaaaagtgatttttcagtgaaggctgtttcagaacggctttttgtatcaaaggcttcgctggtgaggttcgcccagaaatgtggttatcatggctataaagaatttatttatcagtatgaagattcgttgatagaaaaacaggaatcaattaccggaaatacacgcatggtattaaatgcatatcaggaacttttgaataaaacatatagtcttgtagatgagacgcaggttggaagaattataatttatctaaaccaggcagagcgggtatttgtatgtggaaaaggaagttccggactttctgcgcgagagatggaactgcggtttatgagaattgggctgagaattgattcgctcacagatacagatatgatgagaatgcaggcggtctttcaggataaaaaaagtctggtagtaggattcagcatcagtggagagagggaagatgtgatttatttacttcgtgaagcttataaaaaaggagcaaaaacgattttgtttactgcaaaaagcaaggacagttttaagaaatactgttcggaagttgtgctgattccatctttacgacatttaaatcatggaaatgtgatttcaccgcagtttccaattttaatcattcttgatattatttatgcctattatatggaacaaaacaaacatgtaagagagggcatgcatgacagtacaattcgtgctttggaagaagcagaagagatgcatacaaaatttttggatgaagaataaaggagtaaaaaaccaatgctgattaagaatgtaaaagtctttacaaaagacaaaaaatttaaaaacggagcaattgccttatcaggtgacaaaatcaagacagtttacacagaagcaaacatgccggattcagacttggaggaaaccattgatggaaacggtgcttatgcgattccaggtttaattgatttacattttcatggatgtaagggtgatgatttctgtgatggaacaaaagaggcaattgcgagaattgcagagtatgaggcttctattggggtaactgcgattgcacctgcaactatgacacttccggtggaagaactggagcatattttagaggtggctgcagaatacaaaaaagaaaatacagacaagcgcagagctgatttacttggcattaatatggagggaccatttatcagtcctgccaaaaaaggtgcacaggatgaaagaaatattattccatgtgatgtggaagtttgcgagcggtttttaaaggcatcggatggtctggtaaaatttattggaattgcaccggaggagagcgaagaaacgattgattttatcaagtcagtaaaggggaaagtaaatgtctctcttgcgcataccaatgcagattataagacagcgaaagcagcatttgaagctggggcaaatcatgcggttcatctttataatgcaatgccgccgttttcacatcgtgcgccaggagtggtaggtgcggtctacgactgtaaacatgtaatgccggaaattatctgtgatggaatccatattcatccggcaacggttcgtgcgacattcgaaatgatgggagcagaccgtatgattttaatcagtgacagtatgcgtgcaaccggaatgccggatggtcagtatacactcggaggtttggacgtaaaggttgttggaaaactggcgactttggtatcggatggagcaattgccggctcagcaacaaatcttatggattgtatgagaacggtggtaaaagaaatgggaattccacttgaaacagctgttgcatgtgcgacaatgaatccggcgaagagccttggagtctgtgacgagtacggttccattacagagggcaaaaaagcaaatattgtgttacttgataaagatttggaattacaggcagttattaaagacgggatgaaattataatggagtttcgattagcgaaaaaacaggaatttgacagcgtcagagatttatattggatgttgattgatgagacttctcatctgccgtcttttccacactggaaaaaaggtctgcatccatcagatgagtggctgttagagagtcttgaaaaatctcagatgtttgtattagaagaaaatggggaaattcttgccagtgttatcttaaatagcaaggcaaatgaaagttatcgactggtaaactggagcagagaggttccggacgaaaaggttctgattattcatgtgcttgcggtttctccaaaacatgcaggcaaagggcttggcacaaagatgatgcagtatattttggattatgcaaaagaaatcaagatgcaggcagtacggctggacgtaatcagtaataacagttcggcggaacatttatatcagaaaatgggatttcggtttgtacagacacagaggctgtattatgaagtgactggagaaagagattttaatctgtatgaatattatttatagcggtcaactttttctgccaaaggattttgatgagccctgccgtggatgttgaagttgttttaagttttcgcataattctcttgaatttccacatactacccatacagtacaataatgggaaactaatagtatagtgaaaaatacaggaggaatgacacatgaaagcgacaggaattgtcaggcggattgatgacttaggaagagttgtagtgccaaaggaaatcagaagaactcttcggattaaggaaagtgatccactggagatttttacggaccgtgatggaaagattatcttaaagaaatattcaccaattggggaattgggagattttgcaaaagagtatgcacagagtctggcgcaggtttcgggatatacggtgtgtattgcagaccatgaccagataattgcagcaagtggaaagcgggcaaaagaatattcaggaaaattaattgatgaagaacttgaagtcgtaattttaaatcgtaaaacggtaaaacttgcgaaaaaagaagcagtcagattgacgcaaaacgatgtggcaggatatcagtcgcaggtgatttcagtaattacaagtcttggtgactgtgtcggagcagtgattattttcagcgaaaatggcgagacagaacttggcgagacagaaattaaacttgcaaaagcggcagcaggatttttaggaagacagatggagcaatagaatttcgtttgcgagattaaaaaaatggacatgacaaagcgaaaaaattgtcatgtccattctttatttcatgattttatattctattcgtttttaattgctgcctgactcatttcttcaagcaagtcacttttaattttatagagtttgtcggataaatccacatatacttcctgcggattaacgagacgcagagtttcgccccacaaggtctgtttttctttttgacagatgtcacgaatttccattacagatggggaagtatagacacattcgccttttttgaataccggaacaagcagttcacgtaaggtataagtgccaccttctatttttgtctttttccaggttgccatagggtcaaaaataatcatatctttttccgggtcaaagacttcatcggcaaggcagattaaatctgcgcggatttttccggttgctttgtcgtaaatacggaaaattgttttgtttccagggttggttactttttctacgttttcagagagtttgatttttggaatgaaatcttcatcttctttatttttgattgcagctaatttgtagacaccgccaaaagccggatgccctttagaggtaatcagatttgtaccaacaccccaggaattgacttttgcgccctgagcttttaagctgtcaatcagatattcgtcaaggtcactggaagcggagatgatagcatcttcaaatccggcttcttttaacattttatatgcctgtttggacagataagcaaggtcaccgctgtcaatacggattccatagccttttaattcaataccttctgcctgcatttctttaaagacgcggattgcatttggaacaccggatttcaagacgtcgtaagtgtcaacgagcaggatacaggcatccgggtataagttcgcataagctttaaatgcagtatattcatccggaaaactcataatccagctgtgagcgtgagttcctttgaccggaacatcaaacatctggccggttaaaacattggatgtgccgatacatccaccaatcattgcggctcttgcaccgtagattccggcatccggtccttgtgcacgacgcagaccaaattccataattccgtcaccttttgcagcatagacaacgcgggaagctttggttgcaattaaagactgatgatttaaaatatttaaaatggcagtttcaattaactgtgcttccataaccggggcaataactttaagtaaaggttctcttgggaaaataatagttccctctgggattgcatagatatcgccggtgaaatggaatcctcttaaatattccagaaaatcagtatcaaaaattttcagggattttaaataatcaatatcgtccggtgcaaaatgcaggtcacggatatattcaattacctgctccagtccggcacagattgcataaccgccatcgcacggattcttgcggtaaaatgcatcaaaaaccacgatttggtcagtgggatttttaaaatatccctgcatcatggtcaattcatataaatctgtaagtaatgttaaatttagggctctcataaattcttccttttccatacgttcttttgtgtctcaattatataacagatgaggggaataattcaaggagtttggcatagtaacacgctattttggtggaagatgaagtcctctttcataatattcttccaaagtcattccggtaagcgtaaggcttgaagcaagcccgattccggtatagcggatatgccatggctcaaatggaaaaccggtaatctcttctttgtttttaggataacgcaggatgaatccaaaaagagcacaatggcgggcaagccaacagccttctttggtttttgcaaaactttcttctaattcatagttttcatccgggcaggagatatcaagggcaagaccggtctgatgctcactgcatccaggcggagcaacaccggggcgtccatttgcagaagagaacagtgcttcctgtcttttataggagcgataaccggaaattccccataaatggatttcctctttttgggcgcgtttaaacagttcttctgcggcaatggcagcttcccgctgtaagaggcgacgtgggtcgttgcccggggcataaaaaggaatatcaggttcaattaaatcagaaggtatgtagtgagggttcagaggattttttttatttacaagaatagaaaaagaatacatgcaatgcctccatttcacaggaatagacttacatcattttatgcgaaatattcgagaaaaatcacacaaaaaaaatatttaaaaaaatttcaaaaaaagtgttgacttttttctgagtatcatatataattcattttgttgtaagacattgggctatcgccaaacggtaaggcaacggactctgactccgtcatttcaaggttcgaatccttgtagcccagctctcatatcccagacagaagtgtctgggatttttttttacagaaactaaacacttaaattagatttagatagagaaggagaatatatgaaatactcttttgacagttgtgtcagattcagtgaggtaggagaggatcagaaacttacgctcggttctgtgattaactattttcaggactgtagtacatttcagtcagagtcacttggagcaggagtcgaatttttaagaaaacagcatagagtatgggtgttgtcttcctggcaggtcgttattgaacgatatccggctttgtgtgagaaaatcaggataacaacctgggcttatggttttaagcgctttttgggaaatcgaaattttacaatggaagatgaagctggaaatgtggttgcctatgctaattccatctggacgtatttaaacacagaaacaggacttccggtggcagtttccaaagaacaggtagatgcctatggattagaagaaaaatttccgatggagtatgcaccgagaaagattgcagtaccggaaggcggaatggcatatgaactatttccggtacgttcccataacttagataccaaccatcatgtgaataatgaacagtatgtggcaatggcatgtgaatatctgccaaaagattttaaagtatggcagatgcgtgcagaatataaagggcaggctgtgcttgggaatatcatagagccgattgtttatacagatgaagaaaaatgcattgtatcactttgcaaagaaaccggagaaccgtatgcgattgtggagttaaaggagaaaaagagatgagattaggtgaaagacagaaactgattgtagtaaagaaagtagaatttggcgtctatctggctgaaagacaagatgcaggagaaaaggacagagtcctgcttccgattaaacaggttccggcaggaacaaaagagggagataaattagaagtctttttatataaagattcacaggatcgtctgattgcaaccatgcgtcagccgaaattaatgcttggagaaaccggatttttaagagtggctcaggtttcaagaatcggagcctttcttgactgggggctggaaaaagatttatttcttccatataaagagcagaccaagaaagtgcatgaaaatgaagaagtgctggtttctgtttatattgacaagagcagccgactttgtgcaaccatgaaagtatatcattatttacagacgaattctccttatacagaaggagatactgtaacgggaacggtttatgagagcagcgataactttggtgtctttattgccgttgacggaaaatattccggtatgattccaaggcaggaagcacaggggaattataaagcaggggaagaactgacctgccgtgtaacagcagtcagagaagacggaaagctgactttaagcggacgtcagaaagcacacatccagctttatgaggatgcagaaagtgtatatagtattattgaggactttgaaggggtgcttccgtttgatgacaaggcttcaccggaagtgattcaaagagaatttggtcttagcaaaaatgcgttcaaacgtgcagttggacatcttttaaaagagaaaaaaatagcaataaaagacggaaaaatttatcttctttaacgcttcacgaatgaaatcaaatatgttataataagcccgaaaatatcccatgtaggggagactacgaatactatgtttgtcattgtccaagaaggaggaaaataagtggactcgattgattattatgaccgatacgcggtaccttattatgaagaaactgttaatttaagcatggaggagcagttacaaagttttatggaattgctgccggaaaacggggaagtgcttgatttaggctgcgggtcgggaagagacaccttgtttctcgaggaagaaggtttcagtgttacggccatggatggttcaaagagaatgtgtgaactcgccgaaattcatacaggaagggatgttctgcatcttcgtgtagaggatatggaatttgatgatgtattccatggaatctgggcatgttccgtgctgggacactttgcgccaaataaaattcatgaagtgctggggaaaattctggatgccctgaaagatgatggaattctttatttttcggtgcgtaagggcgaaagaaagggaatgtacagcgggcgttattactgtgattatgacagagattccctggatgaccttttagattcttttgataatattgaaatcattgatatatggaaaacaagtgatgcaagaggagacgaacaaagtaagtggtacaatgtgcttcttagaaaaatcagtaaagagaaagaataaaaacgtgtagttagttgatgtactctcgaaatcaagtacaaaaagatttcaagagcacatagttggaaaaaaggagaatgacagtgaattttactcatttgcatgtacatacagagtacagcctgttagacggttccaacaagataaatgaatatgtgtccagagtaaaagaactgggaatgaaaagtgcagccataactgaccatggggtcatgtttggttgcattgatttttataaggcggcaaaagctgccggcattaaaccaatccttggatgtgaggtttatgttgctcctggttcacgctttgacaaagaaaaaggaaaagaagaggaccgttattatcatctggtgctgcttgcggaaacgcaggagggatatcagaatctgattaaaattgtatcttacgggtttgtggatggattttattataaaccgcgtgtggatatggaattgttagaacaatatcatgaaggaattattgcattaagtgcctgccttgcaggagaggttgcaagaaatcttgcaagaggattttacgaagaaggaaaggaagcagcactcagatacgaaaaaattttcggaaagggaaatttctttctggagctgcaggatcatggaattccggaacagaggcaggtcaatcatgaattgattcgaatgagtcgtgaaaccggaattgaactggtggcaacaaatgacgttcattatacctacagttccgatgctgaggcgcatgatattctgctttgtgtacagaccggaaaatcgttaaaagatgaaaatcgtatgaggtatgagggtggacagtattatgtcaaatcagaagaagagatgagacgattgtttccttatgcacccgaagcgattgagaataccggaaaaattgcagagcgatgcaatgtggaaattgaatttggtgtgacgaaacttccaaaattcgatgtgccggatggatatactgcatgggagtatttgaacaaattgtgctttgaggggcttgataagcgttataccgataataaggaagaactcaaaaagcgtctgaattatgaacttggtgtcatcaaagacatgggttatgtagattactttttgattgtgtgggatttcatccgttatgcacgggaacaaggaatcatggtaggaccagggcgaggctcggcagcgggaagtctggtttcttatacacttggaatcacgaagcttgacccgattaaatatgatttgctgttcgaacgttttttgaatccggagcgagtgtccatgccggatatcgatgtggatttctgttttgaacgacgccaggaagtcattgactatgtggttgaaaagtatggaaaagaccaggtagttcagattgttacttttggtacgatggcggcaagaggtgttatcaaagacgttggaagagttatggatgttccttatgtgcagtgtgatacgattgcgaaaatgattccgcaggaactaaatattacgattgataaagcaatgaaggcaaatccggaattaaagaaaatttatgagacggatgagacggttcgcaaactcattgacatgagccggaggctggagggactgccgaggcatacctccatgcatgcagccggtgtcgtaatcagccagaaaccggttatggaatatgttccattatcaagaggttcagatggttcgctggttacgcagtttacaatgacaacactcgaagaacttggtttgcttaaaatggattttcttgggcttcgtacgttgacagtgattcaaaatgcagaaaaactggttcggcgggataaaggaattgagcttgatatggacaagatcgactacgaagataaaaaagtctatggaatgcttggagcaggaaaaacagaaggggtgttccagttagaaagcacaggtatgaaaaacttcatgaaagagttaaaacctggaaatcttgaagatattattgcgggattgtcgttataccgtccgggaccgatggatttcattccacagtatattaagggaaaaaataatccggatgaaatccactatgactgccctgaattagagccgattttaaaggcaacatacgggtgtatcgtttatcaggaacaggttatgcaaatcgtacgttcacttggaggatatacccttgggcgaagtgatttggtgcgtcgtgccatgagtaagaagaaagcatccgtcatggaaaaagaacgccagaatttcgtgtacggaaacgaagaagagggagttccggggtgtattcatcgtggaatcagtgaaaaaacagcaaataaaatttacgatgacatgattgattttgccaagtatgcgtttaacaagtcacatgctgcggcttatgcagtggtttcttaccagactgcattcttaaaatattattatccggtagaatatatggctgcgcttatgacttccgtgattcataatccgtctaaagttgcagagtatattttatcaagcagaaaaatgcagattgaaattctgcctccggatattaattttggagagagtgaattttcagcagaccatggagcaatccgctatgggttatccgcaatcaagagtctcggagcaccgatgattcgtgcgattgtggaagaaagaaaagaaaatggaaaatatcagtcacttcgggattttattgagcggatgagtggaaaagaactgaataaaagagcaattgaaaatctgattaaagcaggagcacttgaccaggttgcaggaaaccgtcgtcaaaagctgatggtctatgcggaaattgtggatgcagttaatcaggaaaagaaaaatgcaatgaccggtcagatgagtctgtttgatttgatttcggatgaagaaaaagaagcttatgagattcagatgccaaaagttgaggaatattccaaagaagaactgctttcctttgaaaaagaagtgcttggtgtgtatataagcggtcatcctctggaagaatatgaagagagatggagaaaaaatattacagcacggacagttgattttcagatagacgaagaattgggaacttcaaaagcaggagatggagaaatagcagtcataggcggaattatcacaaataagactgtaaagtatacaagaaacaataaagtgatggcatttcttaccattgaagatttggtgggaacggtggaagtcgttgtttttccgaatgattatgaaaaaaatgttcaaaagatggaggaagattccaaagtatttatccgaggaaaagttcagggtgatgcagataaggcaagtaaattaatttgtgaaaaaatttattcgtttgacgatgtaccaaaagaactctgggttcagtttgagacaaaagagaactatcttacagaggaaaatgagttcctgaaacttctgtcaggttctcgcggaacagaccgagttattatttatgtacgcactccaaaatcgattaaatatttaggaattgaaaaatccgtgaaaattaacgaaacactgttgggtaagttgtacgaaaaatacggcatggacaacgtgaaagttgtagaaaagagtattgaaaatattacaaaaatgcattaaaattaagtacgattagaggtcaaagaggaaacgtatatattaatactttatggaggaagaaaatgactgcaaaaaaagaaattaagacaatcggtgttttaaccagcggtggagatgctccaggaatgaatgctgcaattcgtgcagtagtaagaagaggattaagtaaaggaatcaagatgaaaggtatcctgaaaggatacaatggtttattaaatgaagaaatcattgatatgactgctgttgatgtatctgataccattcagaaaggtggtacaatcctttatacagcacgttgtgcagaatttcgtacagaagaaggacagaaaagaggtgcggaaatttgcaaaaaacacggcattgacgggcttgtagtcattggcggtgacggttcttttgcaggtgcacagaaactggcaaacttaggaatcaacaccgttggtgttcctggaacaattgacctggatattgcatgtactgagtacacaattggttttgatacagctgttaatacagcaatggaagcaattgataaagtacgtgatacatcaacatcacatgagcgtgtaagtattatcgaagtaatgggaagaaatgccggatatatcgcattatggtgtggcattgctaacggtgcagaagatattctgcttccggaaaaatatgattatgatgaacagaagattatcaacaacattattgaaaatcgtaaaaaaggtaaaaaacatcatatcatcatcaatgcagaaggtatcggccattcacaggctatggcaaaacgtattgaagctgcaactggtattgaaacaagagcaaccattcttggtcacatgcagcgtggtggaagcccgacttgtaaagaccgtgtatatgcatctacaatgggcgcattagcagtagacgttctgcttgaaggaaaaacaaaacgagtaatcggttataaaaatggtgaatatgttgattttgatatcaatgaagctctggcaatgcagaaatccattccggaatatcagtatgaaatcagctattctctgtcacataactacagcaaaaatgactaattaataaaaagtataaaatataaaatgaggctgttgcactgatatacacagcctcgtttttaatttagttatggagaaaataaaatgataacaagtatgtcaaatggacagatgaagctggtgcagcagttgataaaaaaagcgaaagcccgtaaagaatctggtctttttgtcgttgaaggaatgaaaatgtttcgggaagcaccacaggagagaattgaaaaagtgtatgcttcctcttcttttctgaaagaagcagaaaatcagagtgtaattctggaaaaaggctgcacagaaaagaatggaaaattagaagaggtagatgacaaagtatttaaaaatctgtcagatacagtgactccgcagggaattttgtgtttgattaaaagggtggaaactccgatcaaagaaattttaaaaacaaaagatgaaaaagccccatttcttatgattctggaagacttgcaggatcccggaaatatgggaacaattcttagaacagcagaaggcgcaggggtaacaggaattattttgagtaaaaattgcgtggatttatataatccaaaagtaatccgttctacaatgggttccatttaccggatgcctgtgatgcaggcagatttgcttgaaattcttccggttttaaaagaaaataaaatacagacttatgcagcacatttaaaaggaaaaaactggtaccatgaggaagactatacagagggaactgcatttttcattggaaatgagggaaatggtctaagcgatgaattatcagattcagcggactgtctgattaaaattccgatggaaggaaaagtggaatccttaaatgcggcgatggcagcaggaatcctgatgtatgagactgcgaggcagagaagaaccggtagataagtctaccggttatcaattttttctggatataaatcatgctgtgtcaatctctggaaagcaacctgttcccataaagtgccggcttttccatagttgcagtaagggtcaatggaaattcctccacgtggagtgaactttccccacacttcaatgtatttcgggtccatgagccgaatcaaatctttcataataatattcatacaatcttcgtgaaaatccccatgatttcggaaactatataaatacaatttcaaagatttactttctaccatacgttctcccggaacataagaaatgtaaatcgtagcaaaatccggctgaccggtaatcgggcataagctggtaaattccggacaattgaattttacaaaataatcattttccggatgtttgtttgggaaggtttctaacacttctggtgcataatcatctttataaacagtttttttgtttccgagcaggcttaaagttccaagctcgtcttttgttcttgtactcatatcaacgacaatctcctttatataaaatgtatcagttacctcaattaggaaataataaaagtatatcaaaatgcagtacctcttacaagagaaccttagaaaaatgtaaaaatttacaaaatattacaaaaaacaccgtattgacattgaaaagtaatcttgatacaataactttgtaataaaaattaataaatttgtaataaattcaagcaaagtaatcataaggcttgataaaacgcagaaatttcaggaggtaattatgaaagaaagaatgcgccatattttatgttgtataggaacggttggtttgatgatgacaatgggggcagtgcctgccatggcagatactttagatgatgcatcttataactgggacgataaggtggctgcgaatgtagttacatacgctaatattcgcgaaagtgcagatgcagatagtagctgcgttggacggcttccatcgggagcggttgcaaccgtagtcggaacggaaaatggctgggtagagatttgttccggagaagtagagggatatattcgtgaggatttactgttatatcaggacgatgcaaagaatttatacgaagcactgcatggaacaggcgatgttgttacggcagaggcggtaacacaggaagagattcaggaaacagaggaaattcaggaagaaattcaggaaacggcagcagtagagacagatgcttctgcttcaaaccaagatttggatttgatggctgcaattattgaatgtgaagcaggtggggaatcttatgaaggaaaaatcggagttggagcagttattttaaatcgaatcagaagcagtgaatttccaaataccctttcagaagtaatttatcagagtgggcaatttgagccggtctggacaggaaaattagcaagtgtactttcaagaggagcaaatgcagactgctatgcggcagcccgtgatgtctttgcaggagcaaatacaattggtgaatgtctcttcttccatgcgggtggtggaagtggacttactattggaaatcagacattttattaaactttgttaagaattaatacaaaactaatatacaagttgttagaatcagtcttttacgatataatatcctaaagggctgattttttatttcatagaaaattttgttctatgaaataggcaaaataaacaagaaaggaatgtgaggaagatggcaatactatcagcaggcatgatttctcttggttggctgatactgcttgggattctcctaatcattgagattatcacgctggggcttacgactatatggtttgcaggaggagcattaattgcatttcttgtggcgattttaggcggtgcagtctggcttcaggttgtggtatttctggcagtatcaattttgcttttgctgtttaccagaccaattgcaatgaagtacatgaacaaaaatgtacagaaaaccaatgtggacagtctgaaaggggaaaaagcagtggtcattcaaaccatagataacttaaaaggaacaggacaggttgtcatccgtggaatggaatggtctgcaaaagcaagagaagataagattataaaagaaggaactgtagtaaaagtcattactgtagaaggcgtaaaagccgtagttgaggaggaaaaataatatgccgattattttattagcagtcattattttactggcacttatggttgcagcatcctgtgtaagaattgttccgcaggcgcatgcaatgattattgaacgactgggaatgtataaagagacctggtccaccggtcttcattttaaactgccattttttgaccggattgcaaagagagtgaatttaaaagaacaggtagtggattttgcaccacagccggttatcacaaaggataatgttacaatgcggattgatacggttgtgtttttccagattacagacccgagactgtttgcttatggagtggaaaatccgattatggcgattgaaaacctgacggctacaacgcttcgtaacattatcggtgatatggaactggatgcaacgctgacttcaagagaaattattaataccaagatgagagcatctcttgatgtggcaaccgacccgtggggaattaaagtaaaccgtgtggaattaaaaaacattattccgccgtctgcaattcaggaagcaatggagaaacagatgaaagcggaacgtgaacgtcgtgaagcaattctgattgcagaaggacagaaaaaatctacgattctggtagcagaaggtaaaaaagcatctgcaatattggatgcagaagcagaaaaacaggctgcaatcttacgtgcagaagcagaaaaagaaaaaatgataaaagaagcagaaggtaaagcagaggcaattttaaaagtacagcaggcaactgccgatggtatccgctttatcaaagaagcaggagcagatgaaagtgtattgaccttaaagagtctcgaagcgtttggaaaagcagcagacggaaaggcaacgaagattattattccatctgagattcagggcattgcaggacttgcagcttctttaaaagaaattgtaacagatgacaaaaagcaggaaaaataaaattcaacttaaatagtgtttgagtaaaatcaaaaatagaaagattcaagtgcgtgcaggcgtacttgaatcttttggatttatttaaccaaatcaagtaagttccctgcttcaattgcgaaaagcaataagcaggggtggggacttgcttgtatcaggaggggggggcaagccccttctgataaactgcgtagcagctatttggttatgagcaagtagcgaagcggattgcgaatatccacttgacattttcgactaacaaagggcaggtgatttgtaatatgaaaccagtaatcgatttagagaaagaatacggtcttgtattagaaggtggaggcgcaaagggggcataccagattggtgcgtggagagccttaaaagaagccggtgtgaagataaaaggtgtagccggaaccagtgtaggtgcattaaatggtgcacttatctgtatggatgactatgaaaatgcaaagaaagtctgggaaaatatcacatattcaaaaatcatgtcagttaaagatgaacaaatgcagaaactgtttcgcgaaaagaaagcggatataacgatgttgaaggatgcttttaatctgatgaaagaaggcggaatcgatgtgactccgcttcgggaattaattgcagaatgtattgacgaggaaaaaattttaaactctccgattgacttatatgtactcacatttgatgtggatgaatggaaagaactggatattaatatgaaagagtgtgaagatccatcgatgataaaagattttttgcttgcaagtgcctatatttttccattatttaaaaatgaaaaattacatggaaaaacttatattgacggaggggcaattaataatgtaccgcttggctcccttgtggaacgtggttataaagatattatcatgatacggatttttggtgtaggaagagaaaagaaagtaaagataccggaagatacaaatatttatacggtagcaccaaaagtcagccttggaagtattattgaatttgactcaagaaaaaccagaacacatttaaaacttggatattatgatactctgcgtatgatttatggattgaaaggaaaaatttattatattgatgaatcggaagaagagtgttattatttaaatcagctagtaaagcttaatgcagagaattatcggcacatcatgacggcatataaactgtcgcaggctgaaagccggtattgccgaaatatgacagaggttgtactgccggttatagcagaggaactgaaactttcaaaggattggacctataaagaactctatcttgcggttcttgaggcaactgcgaaattatgcagaatcagtaagtataaagtatatacggtagatgaactgcgagaaaagatacaggaaaaactgcatgggctttcaggccgtgaattgcctgcatttgtatggattgttgcaaaagaaattccagaagagatatccagcacagatgaataaaaaggatgagaaataaagaaatcggaggataagaacatggatttaaaaggacgtaattttttaactttaaaagatttcacaaaagaggaaattgaatattttattaatttagcagcagattataaagaaaagaaaaaacagggtgttgcagtcgataccttaaaaggaaaaaacgttgctctgatttttgaaaaaacaagtacaagaacacgttgttcttttgaagtggcagcacatgatctgggaatgggaactacttacctggatccgaaaggttcccagattggaaagaaagaaagcattcgtgacaccgcaagagtacttggaagaatttatgatggaatcgaatatcgtggatttggtcaggaaatcgtggaagaacttgcaaaatatgcaggtgtaccggtatggaatggtctgacaaatgaatatcatccaactcagatgttagcagacttgttaacaattcgcgaacaccttggaagagtagaaggtgtgaaattagtatacatgggtgatgcccgttataacatgggaaattctctgatgattctgtgtgcaaaaatgggcatgaactttgttgcatgtgcaccgaaaaaatacttcccgaatgaggcactggtaaaagaatgtgaagcatttgcaaaagaatccggtgcgaccattactctgacagaagatgtaaaagaaggaacaaaaggtgcggatgttatttatacagacgtatgggtatctatgggagagccggacgaagtatgggaagaacgtattaaagaattatctccatataaagtgacaaaagaagtaatggaaaatgcaggaagtcaggcaattttccttcactgcctgccggcattccatgatctggaaacaacgatcggtaaagagatgggagaacgctttggcatcaaagatatggaagtaacagatgaggtatttgaatctgaacagtctgttgtctttgatgaagcagaaaaccgtatgcatacaattaaagcagtgatggcagctactttaggagcataaaaaatggaattaaaagcaaaatggatggggattccatggaactggacagaagaaatggattccacaaatgaatgggcgaagagggacgcaaaaaatggcgctccctctggcgctgtttatatagcagacagccagacacagggaaaaggcagaatcggaagaagatgggagacgccaaagggaagcagtcttgcgctgtctcttttactgcgccctgattttgaagcagaacatgcaccgatgctgactttagttatgggaatggcagcgtgcatggcaattgagaaaattaccggtcttacagccgagattaaatggccaaatgatgtggtaattaataagaaaaagacaaccggaattttgacagaaatgggaatgtctgagggaaaaatttcttatgtggtagttgggattggaatcaacttaaatatggaatcctttccggaagagcttgcgtataaagcaacgtcattaaagatagagtgcggacacgaaatcaacagagatgaaatagcggctgcgcttttattttattttgaacagtattatgaaaaatttgaacagactcataatcttggatttttaatagaagaatacaacaatcatctggtgaaccgcggaaaagaagtcctgattaaagaagaagatggagaatacacgggaatcagtcgtggaattaatgacaaaggagaacttctggttgagaaaaaagatggaaactgtgtggaaatcttttcaggagaagtttccgtccgtggtttgtatggatatgtgtaatgaattgtaagttggaaaataaattggaatcagggaatgagtcaggaaaggaaagcaacaaagagtatgtataaagataaaattgtgctgtgcggggcaagtgcttatgaacagaaatattattttaatgaagattttaaggcacttccacaatccgttcaggatgaactgcatattatgtgtgtcatgtataccacagaaatcggaggtgtgctgactcttgaatttgatgaagagggagagctgcagtttcgtgtagaagcactggaagccgatgccatgtttgatgaaatcggaagtgcgcttcggattaaacagatccgaaaagaaaaacaggaattattagaagcattggaactttactatcgtgtattctttcttggagaagatgtttctctggacgaggaatagagagtccaatttattggggcaagatagaatggtttaaagggcaatggcatataatattttgaaaaacagaggttaacagtgaagctgagtattggaaatgtaacacttgaaaataatttaatactcgcacctatggcaggagtaacagacctgccatttcgtttgctttgcaaagaacagggagcgggacttttatgcacagaaatggtaagtgcaaaagccattcattttaaaaataaaaatacagaaagtctgatgcggattttacccgaagagcgtccggtgtcgcttcagttattcggctcagatgcggatttgatggcagaaatcgcagcacagattgaagaacgtccatttgatattttagatattaatatgggatgtccggtgccaaaagtagtaaacaatcaggaaggttcagcactgatgaaaaatccaaaattggtgggtgagattgtaagcaaggtttcaaaagcaatcaaaaagccattgaccgttaagataagaaaaggatttacagaaaaaagtgtcaatgccgtagagattgcaaagattgtggaagatgcaggagcttctgcaattgcagttcatggaagaaccagagaacagtattatgcaggagtagcagactgggaaattatccgacaggtaaaagaggcagtttctattccggtcattggaaatggagatgtcgattcaccggaacgtgcaaaggcattagttgaacagaccggatgcgatgggattatgattggacgggcttcaagaggaaatccctggattttttcaagaattcagacctatcttgaaaccggagagataccgccacagccgagtgcagaagaagtaagagaaatgattttaagacatgccagacttcagattgaatataaaggagaatataccggtatgcgtgaaatgcgaaaacacgttgcatggtatacagctggtatgcctcattcggcggcagtaagaagagaagtcaatgaagtagagacgtatgagcagttagagcggctggttaaagacagattggaatcttgacatttttactcatttcatttataatattgggactgttgagaagattatgacaaaattttaaattcattataaaatcaaaaataactgagaaaggatgttttatcatggaagcaaagaaaaacatactgacctatgcaggtcttaaaaaactggaagaagaactgcatgatttaaaggtaaataaaagaaaagaaatcgctggaaaaattaaagaagccagagagcagggtgacttatccgagaatgcggaatatgatgcagcaaaagatgaacagcgtgatattgaagcacgtatcgaagaaatcgaaaaaatcttaaaaaatgcagaagttgtagtagaagatgaagttgacttagacactatcagcgttggatgtaaggtaaaagtttatgatgtagaatttgatgaagaaatcgaattcaaaatcgtaggttctactgaagcaaatagccttgaaggaaaaatttccaacgaagcgccggtaggaaaagcattaatcggagcaaaaaaaggtgataccgtacaagttgaaatgccatccggaattatcgagtacaaagttctggagattgaaagaaatatctaaagattaaggagagtgtgaagaagtggcagaacagaataagaacgcacaggaacaggacctgaacaagctgttaaaggttcgtcgcgaaaaattagcagaattgcaggaaaacgggaaagacccgtttcagattgtaaaatatgatgcaactcatcatagccaggaaattaaagatgcatttgatgaattagaaggaaaatctgtatccgtagcaggacgtattatgtccaaacgtgttatgggtaaagcttctttttgcaatattcaggatttaaaaggaaatatccagtcttatgttgcaagagacaacattggtgaagaatcttataaagattttaaaaagatggatatcggtgatatcgttggaattaaaggtgaagttttcaaaacaaaaaccggagaaatttcaattcatgccactgcagtcacactgctttccaagagtcttcaggtacttccggagaaattccacggactgactaacacagacctgcgttaccgtcagagatatgtggatttaattatgaatccggaagtaaaagatacttttgtaaaacgttctaaaatcatcagcacaatccgcagatacttagatggacagggatttatggaagtagaaacacctatgcttgtagcaaatgccggtggtgctgctgcaagaccatttatcacacattctaatgcacttggagaagacttcaaactgcgtatttctcttgaattatacttaaagagactgattgtaggtggtctggaacgagtatatgaaatcggacgtgtattccgtaacgaaggtgttgatacccgccataatccggaatttacactgatggagttatatcaggcatatacagattacaacggaatgatggatttaacagaaaatctgtatcgttatgttgcacaggaagtacttggaacaactaaaattgtatacaatggcgtagaaatggacctcggaaagcctttcgagagaattaccatgttagatgctgttaagaaatattcaggtgttgactttaacgaaattcatacacaggaagaagcaagagcagcagcagacgcacatcatgtagaatacgaagaaagacataaaaaaggtgatatcttaaacctgttctttgaagaatttgtagaagaacatctgattcagccgacattcgttatggatcatccaatcgaaatctctccgttgacaaagaaaaaaccagagaatccagattatgtagaacgttttgaattcttcatgaacggatgggaaatggcaaatgcttactctgaattaaatgacccgattgaccagagagaacgtttcaaagctcaggaagaactgctggcacagggcgatgatgaagccaacacaacagatgaagactttatgaatgcgctggaaatcggtatgcctccgacaggtggtatcggatttggtattgaccgtatgtgcatgattctgacagactctgcagcgattcgtgacgtattattattcccaacaatgaagtcacagggtgctgctaagaacgaagcaaacaatgcagcacaggaaacaaagccagttgagaagattgatttttccaaagtaaaagttgagccattattcgaagaaatggttgattttgatactttcagcaagtcagatttcagagctgtaaaggtaaaagcatgtgaagcagttaagaaatccaagaagctgttacagttcactctggacgatggaacaggcacagatcgtaccattttaagcggtattcacgcttattatgagccagaagaactggttggaaaaacactgatcgctatcacaaacctgccgccaagagctatgatgggaattgattcctgtggaatgttacttagtgcaatccatgaggaagagggcgaagaaaaacttcatcttctgatggttgatgacagaatcccagcaggtgcaaagctctattaagatgagaaaactgagccttgcggcggtgtgcgcttgcgaacaccgacataaggcgaaaaacacacggagacgtcagtcgacgtgatgtaaagatgtaccgttttaccaaataaacgggacgtacttcatttgataaaaaactaaaaaaacagcgatttacatcaaacttacattaattgatgcagaaatcggtgcaagcaagaaaaaatcgcataattagtgcaatgagtgggcaattccaatcggagttgcccatttttaaaacaaacagaaatacaaatcgggatttaacgcttgagaaaagaggagtaaacatggcaaagaaagaagaaagatttgaagttacatttagagacggaagtgggcttaaagatgaaggaattcgtcaaattcttgtagataaggagactggggttaactacctttgttggaactccggatttggagccagtattacacctcttctggattcggaaggaaaagtcatagtcacaaagtaaaattcttgtttgaaaaattgagaaaacgtaatattgaacaaaaaagaaatgcacagttcttagcttattgtgaactgtgcatttttgtaaataaatacttttaattagccgattacggcatcctctgctgtaaaatgttccagagaattttcttttacctgaatgcagatataagtaattccagaaatatcggatgcaaaaaactgacgctttgcagcaggtgcgatttttagccagtctccagttgaaaggctaatttcttctccatcaattatggctctgccgttacctgaaagaattccatagatttcttcattttctttatgagaatgaacaaatggaacatttgctcctgcaggtagttcgtttaaactgatttctgcacctgttaaagacaacttttcatgtagctcaattcggttttcctttccaatagttgtttttgtgtaatttgccataatagtacctccatagttaatttgtagtttctggttgcttggtattagtatagtgtgagacacatacaaaaacaagtacgcacctttttgtaactgtacactcaaaaatgaatgtgttacaatagactcggaggtgagaattatgcgagcaaaagaagaattaccggaatgcccagttgcaacagcagtatctcttatcggaggaaaatggaaactgctgattttgcgtaacttgaaagagcgtccatggagattcaatgagctacaacgaagtatagatggtatttcacaaaaggttttgacagatagtttaagacaaatgatgagtgatgggctagcatatcgccacgattaccatgagcagccaccgagagttgaatacggcttaacggaactcggaacaaaaatgcttccaattgttaattcacttgctgactttggtaactactataaatcaattattgatgttgtatcataaaagttgacaccacattctcaaggattttgatataatcataatcaatacgagaacaggagaaaaacattatggcacgaaatcaaagaacctatgacaacgaatacaaagcacaggcagttaagcttgctcaggaaatgggtggagctaaagcagctaaagaactgggcataccagatggcacgatttactgctgggtaaaagcatttaaagaaggacgccttagcgcttcagaagcatcccatactcctaaaaatgctttatcacttaatgatgagcttatcgagctcagaaaacgtgtgaaagagcaggataaggaaatccgccgtttaaaggaagaaaatgaatttcttgaggaagcaagtgcttttttcgcagccagccgtcggaagtcagcaaaaaacagagagtaatgtttattgcaagcaaaacggatgacggcaggatcaagggtaaaatttctttttattgcagagcacttcatgtttccagacaggcattcaataaatatctaaaaacaaaagcgactccttggaaatatcagccgttggcagatgcgatggttgctatttgccgcgaagatgaatgcaatgatacatatggaaggatccgtatgtatcaggcgttacagctcaaatagccagaaggagtagacattcctagtgagagaacggtttatcgtgtcatggaagaaattggtcttactcataaaccgaagcgtaagccgaacggtattactaaagcggataaaggagctcggaaatcagatgatttaattaagcgggacttttcagctgagagacctctcgaaaagtgtattacagatatgactgaaataaaggcttccgatggaaaactgtatgtttcagctatctttgactgctacgatttagcagtattaggtctggctatggatacgaatatgaaagctgccctttgtgaacaaaccttagataatgcctataaagcatatccgatgctccggggtgccattcttcacagcgacagaggtacacagtatactagcgagttgtaccgtaacgcaatcaataaatatggcattcttcaaagtatgaacagtgccggtggcagatgccatgacaatgcaagatgtgaaagtatgtgggcacgattcaaagaagaattactttatggacgctacgacgccaccttgatgactgtagaacagttaaaaactcttatttggagatattttatcagttattggaataatcggaggatctgctctgctaatggtggactacctccgatggttaagcggcaacaatactatacttcactacaagaggcagcataaggtcgaacatccttgtgaaaaaagtgtaaaccaatattgacaatatcattaatattgcactacctgtaaaggagtatagagaggatggattggataaaaaattaacagaaaaaattactgtttcagatatagggtatcttgatgtaaattgtgattttaggaagtacaagggtatattagaaaaaataaaagagtatatcaatagtattcaaatatttatgaatcaagtgcctttttatggcgattatatgatggaactgatagatgtttgtaactgtgtaatcaaaacatataatgcgcttatggaaggtaattaccagaatagtgaacttgtttttagttatttggaattgctctatgaccatgcaagtttactatatgcaaatcgtgatttgaagattcaggagtgtattgatagaacagaagaacgccataggcaagccatagatgaagataaaataaaagaacagtttgaggaatttcattaattaatggatcaaatactacataagcatgaggcgttccattttgattttgaaaatcagggaaattatgaaaatatataatttggtttccgatgggtgggagcctataagatttctgcagatgaattgttagatggaaaagaaggaaaagcaacagaaacaaagctggagagagggataaagctgatccgggaacttcttgctgataaaaaagaaatttcaatccgggaattagatgaaaaagcaaaggaacaaggaatttctggaagaaccatgcgtgatgtaagaaaccggatgaagaatgagttggagtatcaagtaaatgaaaagcaggaaaacagtattcggttaaaagaatgatgggtggcagagtcattgaagcaaatataaattttttcggagatgttaagcagcatatagaaggtgaaaaaggtatagatgattggaaaatgctctctgatattgcaagctttaaaaaggaatatatgcaagaaaattatcgtaatgctagacagattacagcatactgcaataaacgatttaagcttaatatgtgtgcaatcaatttggatgggactggagttcatgaaattacaagtgcgagcgcttttgaagaggcgttttctggaattttccaaaaacctcagaatgttggtttgagttgtattattgttaagaatccatcagaagcagatgaactactggcaaagtatgaaatgtatatatctaggattcatgatataacaaaagaatcggtcgaattacagagaacaaaatagaatctgatgatggtcgaacaatctaaaggtcttgaattcgaaactgtatttgcagttaccggtcgaatgagcgaaaatgaaaagtacattacctatacaagagctttgaacgaattgtatgtgtatgatgaagagataaaacttagcgtgatttctataaaaactggaactaatgagaaagctgacaagaaaactaaagaaaaaagtagccgtaagaagcgagaaaagagaagttctaaggaaacagctgatgctgatttagagctataaatataatgaatctgaaatcaaaatgtgtaggaactatatttttaggcatgaaaatggaaacggaggcagtgaaatagatatatcaaaagtagactggaaactttatcgtgaacgtgtctcagactggcaagaacattatatggaaaaactaacagaagaatatgtaaaattactaacttctcccggcaacgcatcagatcatttctgggaactggaaaaaagaattaagcgggacaagaaacatcccgggattttaattgagcttcgcaaatctactgctatatgggatattgcatattttgtaagggataaggtgattacaatggatgaactggaaggattcagtgaggacttgattgatgcagtaaagttgattttaagtaggtaattgttaaacggataataaagttgaaaagggatggtatgaatatgagggatgctataacactaaattattataatagcaatgctgctgttttttctgaagctacaaagaatgtagatttttcggaagttcagcaaatattcataaagcatctctccacggatgcttctattttggattttggttgtggatccggacgtgatacgaagtattttctggatcagggctatcatgtaaccgaaacagatggctcagaagagatatgtaaaatggcgactgagtatacaggcatccaagtaaaacagatactgtttgaagagtttgcaaggcagatttctggactacagatagaaaaaatgtggattaccggagctgtgagagaaggaagaggtgacgagaggtggttggatatattgcttcgcaaggcagacatttgctgaatattgaggcaaaatattataataaactggatatcgaggctttctctcagatgatgaaagatccctcttattgctacaagttttattggttggaggccgtggtacatatcgtttcaggaggaaagaatgagacaacatttgatgagattattgatgaaatgattgcgaatgcctggtattcagtacgggaatttcatattcaccttagtggaatacaggcagatggattggtcagagatggtctggaaagggcaattttacagctgacagaactcagtgatcttccggcaaatgcatctaagatcgaaataaagaatgctattcggaaacatcagacagatttaaagaaagtaaaagaacagttgactaatatggtgccatatagagcactggcaggcttttttacaaagagtaatgaagtaccggactggggaagtgtcaaacgcattacggcgtacattcaaaaggtaaatgaactggtaacacctttgccatatgtattgggtgaaagcagtaaattaaaaaaagaggtgcattttcatccagactgggcagcaatgatccaggacaatacagtcaatattcttggctggattcaatatgaaaaagtgaaatggcttcaaaataataaccctgaagtgcctggtttgatttataagcttactccagtggatgaaaaaatgcgaaagctgtcaaatgtgcggaagttgtggcagggaattatggaagtacaggaaataagggatgttttcacaggacagttagtaaaagaaaaacagtatgatatagatcatttcattccatggtcttttgtaatgaatgatgagttgtggaatctgatgccgatggattcttccttgaattcctcaaaaagcaatcgattacccaagtggaatccattttttgaagttttttctggaaaccagtatctgatgtatgaaatgataaatgaaaaaccagaacttcataaacgatttgaagcatgttatcgggataatctgcattctatctgggctggtcaggaattgtaccgtaaaggtaattccagagaagtattttataacattctggaaaagaatatgatgccgatatatgattcggccagaagacaaggatatgagatctggaactatgggtagaaggagagcacaatacaatgaaattattgggcttatctcggaaagaaaaagaaacttgaacctccattgtaatccaaggaattaagccgaatatgcaggttgatgacgttcttttgaagaatgctacagaaagtcatattagccagcatattcgaattttggaagaaagtgttcgtcttgtgttagaatctaaaaataaaaaaacaagagaagataggtatgagttggtattacaacattttagcgcattgtcaaaaatccggaagtatgccgataaaaatcagaaaaaaagaattgcggatgcacaggattatttcatgattatgaatgaacactataaacatccagaacgtatcagaaagcaggaaaagcaaaaattgaaaagacagaaacgagattcgttttatgaaacatggaatcatcaggattctttgcctgtttatattgcaggaagttatgattttcacacagcatatattggaaacagacgctgtataatgtttgctccaacagaagaacttgacacacttccggcattgaaaaaacaaattgcaaaaatacagcaaattgataatgtgccagttgtatttgaacttgcgacagtatctaattatcgaagaaaaagccttatagaaaataatataccgtttattactgataagcaggtctttcttccttttattgggacaatgctttttgatgaaaaagacccacaaaagctgacgggtaagtttgtttactccacgcagcagttgtttttattttatactacgattttacaatcacagtcaaaggagtgggggtacaggctttcattaagagaaaaaaagaagaagtattttgtttacgaatatctgtttgaagagaatcctatattaagcgtgaaacggtttgatgctttgagcgaagaatggctggaatttattaaagacaaccgaagtaaaggcggattacaacacaactatgatgtagtaattggaccggttgcagatgataatacaatggagactgttcaactatatatagcgaatattttgacagcatcagaagcagtggaaagattacggtataataaagtaaataatcaggtatcatttcacacagagaaagcgttacagtatttacagttggtaaggaggacttcttatgccagaaatgatttatagttttaatggaaaagatatcactatgaatgtatgcatacaaattagagatgtattaaaattattgcaacaacattatcaaatcagtttcgaggaagcagcattgaaattttataaatccgaaacgtataagacattgcaggaaacagaaaatggattatgggcagaatcggcagaatatatagctgacaggtattatgaagaagccgaaagtaatccagttgccgtttaaggagtggttgatatgtgcaagacgatgcaggtacgagaggctattacacaaaaataagaaaatcagttttgtaccaatcatgtaccaatctgtaaaaaatatcgtagagatataaaaaataagacctattgtggagccattatccacgataggtctttcatattcgagccattaaaaattttttctacatttttttatgtatgtctgaatcagggtgaagcatatgcaccggaagaaatacggagaaagtctgtctgtataaatgaagatatcggagaaattctgaaggaactgtagacttgacagacagattcgatcgaagtattagaataaaattgtataataacggtaagagaaaaaagtaattaaaataattggttttcgagtagcacaattatattagaaacactgacttttaacggttggtgtttcttttttgcactttttgagttcatctgacattctctgctttcccacgtgtgattaccggaaaaataaatttttctaattatataaagtgttgcgactatctttgatgtctgtacgagggtatggggaatcggaatccccatcaagagacttacccggaggtatgccgtagccataaaatggcgatacggtaatacttgggtggatcttgctcttaatctacaaaccctcttacatatacaaaagatggagaagtaaaatacagggtgtgagagaaaagaattttagaaaaatttaaaataactcaaaaacttgatttttaacattgcctaagttaaaatgaaagaaaataagttaaaaggagaacgagaaatatgcttacaagcgtattcgggatttctataaaatatgaagcatggaatcatcaggattcgttgcctgtctatattgcaggaagttataatttttacacagcacatattggaaacagacgctgtataatgcttgctccaacagaagaacttgccacacttccggcattgaaaaaacaaattgtaaaaatacagcagattgataatgtaccagtcgtatttgaacttgcgacagtatctaattatcgaagaaaaagtcttatagaaaataatataccgtttattactgataagcaggtctttcttccttttattggaacaatgctcatggatgagaatgaacccgtaaagcgaattgaaaaatttgtttattccacgcaacagttgttcttgttttatctgtacagtaagaaaaagcgattgtatatttcagaagccggaagagtgcttccatttacagcaatgaccttgaccagagcagtaaagcagttggaagcgacggatttatttcttgtagcaaaagacggtgtcaataagtttattgagtcaaaatataagcgagatgaattatttgaaaaagcgaaagtatatttgacgactcctgttcgaaaaacaggatatatagataagacgcaagttacagaaaatatggtctttgcaggggaaacggcactttctgaaaaaacaatgctaaatccaagtcgagttgttacctatgcaattagtgagaaagattatgataaaaccttgctgactaatgaattgatagacccggataaacaggtaagacttgaattatgggcatacaacccgaaacaattttcagaggataacagtgctgatgatatttccattgttttgtcttttacagatacaaatgacgagagaattgaagaagctgtagatgaattgcaggaaagaaggttgaaggagtaatggtcagagtcttgtcgatttccggactataattctgccataagcttcagaaaaagaaaaagcttacattgaaaatgattttgtgataaactggaattcgaattgtcaattttgcagtgtgacggaatgttttacactgtatttatttttgaattttaggaagaagaggaacaaaatatgccaataggagtgataattaatgccttgtcaattgctgtcggcggtgtgattggggcattattcgggcataaattgcctacgaagcttaactcggagcttaccaagatttttggtatttgttcaatgggaatgggtgtcagttccattgggcttatgaaaaatatgcctgccgtcatttttgcagtgattattgggactgcttttggtttggctgtcaatttgggagaaattattaacaatggggcagcttgcatggagaaaccggtgggaaaactttttccaaataaaaataaatcaatgtccagggaagaatatatgtcgatgcttgtaacaatcattgtgttgttttgtgccagtggaacaggaatctatggagcattggactctggaatgagcggtgatcatacaattttgatttctaagtcaattctggattttttcactgcgatgatttttggaggaactttaggcatggtgattgctgtggttgcaattccgcagtgcgtgatttttttggtaatctttgtagcagcgaaatttattttcccactgactacgccggatatgattgcagactttaaggcatgcggcggttttttgcttcttgctactggttttcgaattgcaaaaattcacgattttccagttgcagatatgattccggctatggtgcttgtgatgccggtgagttggttctgggtgaatgtgatagtaccgctgctataaggtggtagggtaaaaattgagcaaagatttaaaattaagtagaaatttaaaatgagttgagatttagaataagcagacacaattgtgcagaaagacagttaaaagtaagaaaataaaacaaataaatagaacctgctcaggcacatatttgcttgagcaggttctattttattttaaaaagtttcttatctaggccatctgcctttcttatccatcaacggtgcaaacgcctgatgtggttcactctggtaccaataagcaacacttgcaacatcatcctgtcgttcaaacaggcctttataacatactccaatctgctgaatcgtaacttttaaatcttcttcaaagcaaatcggatccatcaaatgccagcgataaaagcctcgcatcggtgggcagtcatcattatgataaggattatgcacgagttcatcatgtgcggaataataagggtatcccaaaaatggagaattataagtttgttctaccgtctttccgtttacctgatgtgcaaagctccaggagccaccaaaatagtcctcggttccggtaccacagatagttggatattcgtcatctccatcaatataaaatttaacttcgccttctccccaccaatatctctcaagtgttgtcaaagcaagataggtaccaacataatgaccttttccttttacattgtccagaatcacataatcctttgcaagttcggtaattctttggcgtctccactgtgcatgaaaataagcggtatcttccggtaactcatcgtataaacagtaatctacttgatagaagaacgcaggaattggattatcatgctgattttctaaagtgatttttgcttttttacggaatggcatttcaaaatagctgttaaagcctctgtttggaacgacagagattggcatagaagttacaagacattctcttgcaaaaccgcagcagaagaagtcacctaaaggactttcgaccgatggagtttcctcatcgtcccagtacatgcgaagcactaaatcgcgaagtacataacaatcggcatctgatgttttattatcaaccgtaatccagatatgctggataatacccggtccatccatttcggctaatataaccgtttcatttggcataatatcttttaaacatggacttccttttctggaaggaccaagatggcttgctgccatcccgccctttcctttttcaccagttggattttctgcatttatcgctctggatcttccgttttttaatctaaaaatatctgacattatcgattcctccgtttattgttttacaccgcctgccatgacaccttccataatctgtttttcaaagattaatacaaagataacgattggtaacaggataacacatccaacggtactaatcaaatcccatggcatactgtatgaggtttctcttgggattgttgtaattgcaacactgagtacttctattttttgtgcaaaaaacaatggtgtaaacaaatcgttaaggcagttgataaagttaatgattaagatggttgcaattgcaggtttcattaaaggcagcgtgatatagaacagtttctggaacatattcgcaccatcaatctctgcagcctcatccattgaaactggaatttcacttaaaaagttacctaaaattaacatggtaaacggaattaacgcacttgtgtacatgataaccagtcctgggaaggtatcgattaatccaaactgtttcattaagtcgtataatggtcttgcggttacgattcccggaatcaaagcagaagccacgattgcagcgtatacaagtgtaagtccttttccggaataacgagtaaatgcataagcggacattaaacagattacagtggataagattaatgagcacacggtaataattgcagtatttaaaatcttttcgcccagattcatttgtgtaaagatccggatatagttatctagtgttgggtgcttcggtatatagtgaattggggaactaaacaattcatctgccggcgaaatagatgatgtaaaaatccaaagtaatggaagtaaaataataaaggcaacgatcaagattaaaatccatttgaatacggatgccaaaattcttttgttttttggtttcattttccacatctccttctatatttaatcaaatttctttatcgccttaagctggataaagcttaaaatagtcataacgataaacaagcaaaccgcgattgcagatgcatatccaagatttaagtttgtaaaggcttcctgcataattcgatatgctaacagtgaggttgaatctccaggacctcctgaggtcatcgcatatactaagtcaaaacttgtcaatcgccacatagtaaagaagatagaaagacttaatattgttttcataatgtttggcaatgtgatggaaaagaaggaacggattggtccggctccatcaatttttgctgcttcataaatgtcggctgataaaaactgcagtgcagcaagtactaaaattgcgaagaatggtaaatctttccataagtcaactgcgataactgcgccctgtgcagaatttgcatgcacaagccagtcaaagtgaaagtccggaacaaatttgcggattagatcattgattaatccgtatgcgtcgttgaatgcccatcttgcagcaagtccggctactaccattggcattgcccatggaatcagtacaatagtacgtaagaattttttacctttaatcttcatatttaacattaatgcaagaattacgccgagtatcagatggaagaacatggatactaccgtaaatattacagtaaatcgaatagaagataacaatttttgatcgctaaagattttaatatagtttcctaatccgataaactgaaagtcagttccttttaacaagctcatgtcataagtgctgttgataaaggtcataatgattggataaagtgttgtagatgctcgtacaatcactaccggaagcaccagaagccatgcgatccatagtccctttgtcttctttttcattgctatttacctcctgtgaaatctctgagatacgatatgaacgactttattttacgacataagtatcaacagattgctgtgcctttttacaaaattcatcgagtgttaattcatcagatacatactgctggaataaagaacccatatcactgatgaattccattgcctgaggagccataggacgcgcaagcagttcagtatctgctacgtattctctgatttcatccaaacctggcagatccattgcagctaactcatcgctttccaatacatcggttcttgccggcagtctggaagtcatttcggtgtaatccagctcgccctgttcactagctgcgtatttaaggaacttctctgcggctgctttatttttggaagcactgttcaggacatatccccatgtagacatataagcggttttgttctcaaatgttggcataggtgcaatgtgctgtttatccgcaccatattttccggaattaacaaaagtctggattgcacctacgtacatgaaaatcgaagcgtagtcgccatcaaagaatttctgcatcattgggtcatactgatcggcaagctgagaaatcggagtttcattattcttcatcatgtcgtacatgaattttaccgcttcctgcgttttcggattagtccaatcatagtaatctccaccaaataagtttacaaacgttccgattgagttaaatacataagttttttcccatgcatcgccatatccgtatttgccgtctgctgagtttgcttctacatatttctcgaagtcttcttttgttttaatctcagtaagacctgcgtttgccatcttttcttcatctacccagaaagcaagaatatccataaagcaaggaacagaataagcattatcgccaaccattgtcatttctttcatatatttctccgggaagttcttcataacttccggtgtcatgaccgtatcctgaagtggctctaagtatccggtgtttttaaatgcactcatcatttcatcattgattgtaatcacgtcgatgctgtcatcgcctgaggaaaggatggttgtgattttggcctgacggtcgtctgtgttggttggacacgcaattgtttcgatttccagaccggttgcttcttcggctttctggatatattcatcaaatgcttttccataagtggtgtcctgtgtcattaaagtgattttgttggaattttcattttgcttggcttctgagcttcctcctgattttccgcagccgctacaaaggccaacgagcatggttgctgtgagtaatacactaacgatttttttcttcattttcttttacctccaatgtttaatatgtactttcgaaattcttctgtcactgatttttgttgacttaatcataaaaaaatacaggtcaaaaataaatatatttttttatgcatgatttatattatttttcgtttttgatgtaaatgattgtattttttagtttttttgattagaattaggctggaaggagtgatacatatatgcagtttgctaaaagattaatcaataccatcaaagaacattttcgcttaaagctactcatttgctttattctctgtgcgatttttcccctttttgtattgggaacgatttcttacaaaatttcttacaatatagcaaaagacaacatgctaaaagaaaccaaaatagcgtgtgaaaaaaatcaaaatctgcttgaaaatcgaatgactcagatagagagcttagcagattcgattcattttaatttatgtgtgttatgcacaaccccggaacagccgatgtcaaaatatcttgataccctttcctcggtgcgaaacaatattacttcgatggcggattcatttaatatttatcatgtaaatgtttttctgccggaggacagttttgtgtcaaatgaaggaatcacgttttgttctttatcggaaatggaagattatagagtacagttaagtgattttgccaatcagggaattaaaccgaagtggctgtttcagaaacgagtgaagtttccatatatggtaagtaaaaacaaaaatcccgtaggcgtactttcatgctatcggtctgcccaaattaattcgcaacaatattgttttgcacttcatataacgagcgatgaattaagctactatttggacgaattttcaaaagagaatccttctgtttcttacataatagatgcggagggaaccatcttagcaagtacggatcagacacaaatcggtacgtctttgactaatgaaaaacggaatgcgcttacccaaaatagaaagacgtctcatatttcatataatgaatgtgaaatcatttcagcaccggtacacaaccagctgtttttgattactgagacaccggattactatattcgtcaaagtgcatcgcttcttgtaaaaatgattttcgtgtgttttataattgtggttccgttgacgatgtttgcaattatctgggtagcggatcaaatgacaaataaagtaaatcgtttgtcacattctatgtctgagcttaagatggacaacgtcatagatgcaacacagattaatgagttggttccggcaacttcttctcatttagatgaaattgatacgctgacggttacttgtgctaacatgattacagagttaaatgcgagctttgaaagtaatctaaatttaaaaatacaagaagaaaaattgaactatcagttgctgcagtcacaaattaatcctcattttttatataatattttggcatctgtgcagaatttattgtcattgggggaaattagcaaagcagataaaatgcttgctgatttatcacggttttacagagggctgttgcgcacctcaaatgatttgattccgattaaaaaagaactggaaatcgcatgtttgtacatggagatggaggcattatgtaaagataatttgtttgattgggatatagagctggaagaaggaatcgaaaactttcttatttgtaaatttacgttacagccgattttggaaaattcgattcagcatggtttaaaaggcaatggaatccatatgcatatccatatttctatcacctatgatgatgatatgattgaaattataatttcggatgatggaatggggatgtctcctgaaaaattaaatgaaattcaggaaagcattgaatccaaacagattcattatgagaagcattttggtatcagcaatatcaattcgcgaatctgttcttccttgcaaggtcatggtacacttaaagtagagagcaataaagattcaggaacaacgattcatatcagaattccgcagttactggaggattagtaatgtacaaaattatgattatagatgacaatcatatctcggttgatgggatttgtcataatattgactggtctgatttaaatgcagaagttgtttgtaaagcgtatgatgggcagcaggcacttaattatttgcagaataatttggtggatttgattatttcggacattgaaatgccacagttagatggtttatcgcttgccgaaaatgcactgaaactgaattcctctataaaaattatcctgatcagtgcatttgataaatttgaatatgccaaacaagcgatacggctgggagcatttgattatatagagaagccacttgattatgcttatctggaagaaatcattcgtaatgcgcttgatatgctcgataaagagcagaagaatcttgcaatcttaaaaaagagtcgtccaatcatggttgacaattttttccataaattaatacaatcttcaagcgatgaagcgcgatatacactctcagattatgcaaattatcttcaattaaacttggaatatcattactatcaggcgattgtcattcgaatacaaaacgcagtagaaatcaaagaaaaaaacggaattgaagagtatcatataaagttaatgagcatgtcggatacgataagagaactttttgataaaaactttgctttggtgcatactttgtcaacttttgatgaaatcgtgttgctgcttgggcataattattcaaattcaaagtacttctacagtacgtcatatggattgttgacagagttaatacagatgtataagcatcatctttttgaagtaaatattggaattggcagcattgttaaatatttgtggtcgttgtcgtcttcgtattcaaatgcattaaaatcactggaatatcgttttttctttccacagaaagatatctttacaatcagtgatacagtagacaaagattatgctgtagagctatatgaggtttccggaaatgaagaactgatacagctgttgtgtaaaaatgatttggatggagtaaaaaaatggattctctcattttcagaagaattgacgcaaagctataaaaacaaacaatttatctttttgcgtgtctatcagcttttggggcatttactgaaatttctttgtgacatggggcttaacatcaatgatatggaaaaagatattattaagacgtaccaacagcttgatgcgttctcgacaagtacagaaattttccaatggctgtttcgcttgtgtcagacaatttctgatgaaatgaacctttcaacgaaaagccatcaagagcatgtttgtgctgcaacgttggagtatatacagcagcattatcaggataacacattatgtttgaacgaaattgcggaaaatgtacatatcagtccggcgcaccttagtgcgctatttaaaaagcagcgccagcaaaatatttcggatgtaattgcagacattcggattgaagcagcgtgtagtttattaaaaaataccagtcttccattgaaagagataagtgcgaaagtaggctattcaaaccaatattactttagttcttgtttcaaaaagaagaccggtaaaacaccttcttcgtacagataaaaaataatcggctgctttctgtattattttcaggaagcagccgatagctttctactcggagattattctttttattcggttttgaaacaaaaaagttcaaattctaaagttcgtgtagctacagcattatagagcagctgctttttgaattcgatattccgtaggtgtcactccataatattttttaaattgcttacaaaaataatcaaccgtttcaaatccaacgttttcagcgataacaattacttttttctttgttgtagtcaaaagaattgctgcttcctgcaatcgatattttagcaaataatgcaccggcgtatcatgaagatatttgtgaaacaagtttaacgccgtgcttttgcttaccatggcctgttcggcaatctcttctaaagaaagtttttggttaaaattttggtgaatgtattgcatcataagttgcagtcggccttgtgatgaaacaatatttacttgtttttcttttgataaatcttcttttatatgggagtaaatcagataccaaagttcttgtacaagacaagaggtgagcagctccatttcgccttcttctatttggagtgatattatttttttcataacatgtaaagcttctttttgccaggggatttccggtgaaaaaaacaaacaatctaatgctgattttttaatgggttcaatgtacttttgataaattcggctgtttgaagctgcaataaatgttggaagcaggagaaaatttggaatgacggctcctttttcagaataaaagcgatgaagaattccggaattaacccagaatccttgtccttcagttatggaaaactgtttttctcctgcccaaaatatagcatttcctttttcaacaaacacaaattcgaattcgttatgccagtgccattcgatacaattaaaatcaaataaagacagattgtcataataaaagtgaaatggataatcgctacgaccatgctgaattgtttccatcatattttcatctgtcaaaattttattgtagtaggtgttataatccatgttttttctccgtatttcttctccataatttttgaatttacgatattatacaataaatatctgatatattccagtgaaaaaagagtgagattgtgttattgtacagtagacgtttttgtgaaaaagaacgtagaataaaaaaataagcagaaaggaaattttttaatgaaaagcaagtatagaaaaacattaattgcctgctatttaggattcatcactcaggcaatcactgcaaactttgtgccgctgttgtttttgatgtttcacaggacttatcagatttcacttggtaagattgcttttatttcaacagtgttcttttttacacagttgcttgtggatttgttttgtgcaaagtatgtagataaaattggatatcgcagaagtgttgttgcatctgaagtattgtccggagtaggtttgattgggctggctgttttaccggagctgctgccttctccttatgttggaattttagtcagtgttatgatttatgcaattggaagtgggcttattgaagtacttggtagtccaattgtagaagcatgtccgtttgataataaagagagtgttatgagtcttttgcactcattttattgttggggttcagttggagtaatcttgctctctactttattctttgcaatttttggaattgaaaattggaaaattcttgcatgtatttgggcagtgattccattgtataatatctttaattttctttcttgtccgattgaatctttgacggaagaaggagaaggtatgagtatcagccaattattccaaatccctattttttggatcgcaattattcttatgatttgtgccggagcaagtgaaatttctatggcacagtgggcatctgcttatgcagaatccgcacttaatattccaaagagtcttggagatattgtaggaccgtgtctgtttgcagtcatgatgggagttagtcgttcattttatggaaaatacggtgaaaaattagatttgataaaatttatgattggttcaggagtgctttgtcttgtttgctatttgcttgcagcattaggtccatttccgattttaaatcttgcaggttgtatcgtatgtggcttttcagtcggaattatgtggccgggaacaattagtattacttccggtaaaattccgcttggaggaactgccatgtttgcattacttgcgatggcaggtgatttgggtggatccatcgggcctggtgtgattggggttgtgactcagaatgcaaatgataacttgaaagccggcatgttggctgcctgcgtctttccggtagttctgattttatcggttctttttattagaaaaaagagagctgaaattaagccaataaatcaaaaaacagaatcttttttatgagataaagtttgaggtgctcgcaaaaagcggcacctctttttgcgttatattattttgttttgacaggattctgaattcatttgatataattacgaaaacagactatacttaggataataaggtttgcgtttgcaagataaataagccaaagcggaggaggaaaacagtgtcaactacccacctcccaagggaagtgggggttcgcttatgataaacgaaaggatgtcatgcggcttgtggtattttgcaaatgtctatagatacccatggtagaaaggaaacgtttatggagcatttgcgttgtgtagtagagcgaattacatatcaaaatacagagaatggctacacagttttgaaatgtgctgtgaaaaattataatgaccttgtaactgtggttggcacaatgccggatactcatgttggttccgtattatcgctcgacggtatgtggaagatggatgccaaatatggacggcagttttctgtacagaaatttgaagaaacccttcctgcaaccgtatatggaatagaaaaatatctgggttctggtttagttaaaggtgttggaccgaagtttgcaaagagaatcgtgggaaaatttggagaagataccttagatatcatagaagagacaccggacgaactgctgaaagtgccgggaataggaaaagtcagagtggatcggataaaaacgagctggcaggaacaaaaagaaatcaagaatattatgctgtttctgcaaggtcatgaggttagcacttctcatgcaacgaaaatttttaaaacgtatggaagtgagagcatcgccattgtaaaagaaaatccgtatcggctggcagatgacatctggggcattggatttaagacagcggattcgattgcacaaaagatgggaattgagaaaggaaaatttatccgactgcgcagtggtattttttatactttgaatagacttgcagagttggggcactgttatgccacaagagaacagttgattgaaaaagccagtgtccttctggaagtagaacagccggaactggagattacattagatgaaatgctccgtacgaatgatatcattcgagatgtgtttgaagaaaaggaagcaatatatcttccaccttattatttttcggaaagtgtatgtgcaaagagactggttcatttaatgtcaggcagacaaaaaaagtgtgagaatccggaaaaaattttggagaaagtggcacaatcatcccaaattatttatgatgagatccagtggcaggcggtgaaaacagccatttcatctaaagttatggtgttgaccggtggaccgggaaccggtaagacaacgacaacattaggaattatttccgcatacaaacaggcagggtgtgagattattttggctgcgcccacaggaagagctgcaaagcgaatgtccgaagcaacgggcatggaggcaaagaccattcaccgcttgctggaatataaaccaccggaaggctaccagaaaaatgaagatcatccgttggaaggggacgttttgattttagatgagtgttctatgattgatatcatgctcatgtacaatcttttaaaagcgatgccggagcagatgtctttgattttggttggagatattgaccagcttccaagtgtaggtgcaggtaatgtcttaagggatattattgattcgggacaagttccggtggtacgtcttaaccggattttccgtcaggcacagggaagtcggattattatgaatgcacatcgaatcaacaaaggggaagggattgatatgcgtggcggaaaagatgcagattttttctttgcgccaaaagaaagtaatcaggatgtcgtaaatacgattgtccaatattgtaagacaaacctgccgcgatattatcatgtagatcctttgcaggacattcaggtattgactccgatgcagagaggagaatgtggagcgattaatctgaatcaggtactgcaagaagcaatgaatccatcaaaaatctttttgcgaaggggtggaacgcagtatcggctgaatgataaagttatgcaaattcgaaatgactatgagaaagaagtatttaatggagatatcggtacaattacaaaagtagacatggaagagcgggagttgaccgttttatttgaaacaagggaagttgtctacgatgtgacagaactggatgaactgatgcttgcttacgcagttacaattcataaatcacagggaagtgaatatccgatagtcgtcatgccatttacgatgagccattttgtgatgttacagagaaatcttctctatacaggagtgaccagagcgaaaaaaattttggtactggttggtgaaaagaaagcaatttattatgcgataagaaatgaaacgacaaccagaagaaatacctgtctggcaaggcgtttacagtcggatagtgaagaatcaaaggaagccttcagccatctataataagtgaaacaccgtccacatggttagaaaggaaatgtttcaaatgatatatattacaggagattgtcatcgtgaataccggagatttaatactcaaaattttccggaacaaaaaggaatgaccaaagaggattatgtgattgtctgtggggattttggcggagtatggagttttgaaaaagaagataaagaagaaaaacatctgctcgactggctggaagaaaaaccatttacgacgctgttcgtggatgggaaccacgaaaattttgaccggctttatggatatccgattgaaaactggcatggtggaaaagtgcataaaatcagaccctcggtattgcatttaatgcgtggacaggtctttgaaatttgtaatagaagcatttttacctttggtggagcaagcagtcatgatatcagcggtgggattttagagatggatacatcgaattttcacagagagataaagcgtttaaatcgagtgggaataccgtaccgtattaatcattggagttggtgggcacaggaactgccatccaaagaagagatggaagagggacgaaagaatcttgaagagcataataatacggtagattttattgtgacgcactgctgtgcttcgagtactcagcagcttttggggagagagggatttgaagatgatattgagacaaggtatttggaggagatactacagagcacaaactttaagaaatggtttttcgggcattatcatgacaatcagaacgtgacagaaaaagaaatattgttgtatgagcaggtgataaggattgcatgatatgaatcaagcagatattcgcaatttgtctctctgattgattcggttaaaatcataaaaaagacgtcattccatagaagatgattcctctatggaatggcgtttttaatttggtgccttgtctggcgtctgacaccggtcaaagcaggttaggatgttgaatgcttctgtcagagagagttgaaagctccctctgacagatcgcaaagtgactgcgttcatgagcaagtagtgaagtggattgcgaatgtccgctttactgattttgggtggtgtttgacgctgattcttttgattcgttttcttttttctgcttttgtttgaagtttttaacaaattcaggatattctttttggtgcatttgatggttctttatgaaaagattaaagtgttcaggttcacttatgatttcctgtgatggatataagctgtttttgcgtatttgaagaagaacattcattctttcattttcatctggaataaaataagaattactgcttataaaagattcaaggaatactgaacaattagtaaatacagctttatcaggtgttaaaagtctttttagtgtttcgtctttacgcaggtcttccagagtgtcttggtctatgacgattggagtagaatttagtgataaaattccacgtagcatattggttgtattaagattatcaagattttgtcggactcggaataatgccattttttgaaagagtggttcatgagttttgttagtggaaaaggtcagcataccagcaggaatataatatcgaatatcagaatttaaatttaaatatcgaaacataagagccatagccctgcgaccagtatcgtctgaaatgaaactatatgctatagatggattttcaagaagtttcaaatcaccagtgagtttaaacagaggcatagggtctccataaaaagttgtatttgtttttatttcttcaaaagttacgatggtgcgtccttcggttatgttaacattcattttggcttcttgaattttgccatctttaataggttttaaatgttcttgatggtgtttgggattaaaataataacaatagtagtcataagcatgatattgattggtaagctgatgaatcccagagtctttaagtttcccttttgtaatacgggaaaagttaaagtcagatgaagaaggagtctctgttgtttccggaagctcacagatactccataaaggaatatcaaaaatctgcgcaagtgcgacaagctctggaagttttacttctctgtcggattcaccatcgagcatagcgcgtattttactgggtgaggttttgatattaaaccgttgaaacatcatatctgcgataccggaataatttaaagtctgttccccgagagcccgttcaaaatctctcttccatttaaataatcgtttctttacaagggaattataatcttgatttccgtttgaattatctgaagatttagagttcataaaaattcctcccaataataaaaatttaaagaagtataactattttcatcatatcattggtacgacaggagttcaatgcgaaaaaatgccaaaaatgaatcatattatatcaaaaataaaaaatataaaaatcaaatctgttataaataaagttaataagactaatgataaaaaataataaatgtgataatattacagtacatcagatatctgacctttctaaaatctttttaataatcagagattttgaattttaaaagaacagagtttcaattttaagatagtagagtttcaatttatggaaaattagagaaagatgaaagtataaaattatgtttaaataacaagtgtaaaggacaagggataagtttttagatggtaaaaaataagggagcgtggtattatgtataagtgactttgcaaaaatggatttataaaaatcagagatacaaaagagaaacagaagaaaaaatctgatagagaagaaaaaattaagaaagaaaatatatcagaggggaaacggaaaatatgagcgaattttcaactgtattatcgcggtttgtgaaagagaaagatgtcaacgtataccgtctggcaaaatattgtggatatgacagagctaatctttataaagtaatgcgtggagagcggaaaccgccgagtctggaagttttaaatctgttgtgtgaatatatgcatctttcaccggcggaggaagaaattttagaagaaaattatgagattacaatggtaggacacgataactattatcgaagaaaaaatgtaatgaaatttttttctgacttttcaatgaccagtaatttggaaaatgtactgccaacagtagaaattaaagaggactttgaaattccaaattcaagttatatgctgcttcgcggcaattatgaaattaattctgcgctttttcatattattgcagatgaaacaaaaaaccaaaaaggacatattcagatactggcacagccggaacatgcgttaggaaatctgttggcaatgcgtggaaatacttcaaacgaaataataattgaccatattatctgcctggataacaaaccggagattgcatattcaaaatcaaattatacgttagattgtctgaagcatattcttccattatataattacaattacgattataacacctggtattattatgcagaccttggttcattgggaagaaatttctctgtatttccgtatatgattttaacttcaaaatatgtatgtatgctgtcggatgatttgcaggacggatatttaagtaatgacccggaactgattaaaatgatgaaagagcgttttgaaaactaccggagacgggctcatcggttagtggaaaatgtgcagggtgaaattgaacagcagtatatgattatgggaatgttaatggcaaatccttatccgaaatatgcatttcatatgtctccatgtatgatggcagtattagacagagaattgattgaaaaatatctggtgcctcagcttccacaaagagaagaattagttgaggtattatgtgagtatatttcaaatcttcaaaaacaggatatgacttatgtctgctcaatggaaggaattttacagttcattgaaacaggaatcatcagtgaatttccgaaagaaatgtatcagcttccggataaagaagacagaatggagttagtgaagcgactttttgatgaagaaaaagccggaaaagtacatattttgaaaaaaaacattggagatttaaaggcagaattatatttatgcattacaccggaaagcggattgctgcgatttgcagttccatctaagaatgttttaaaagatatctccttagaagaatcaggtttggtttcggtgttctatgacttctgtgaaaatttaagcccggaattattttattcggaagaagaagcaaagagaattattttcggataaatgtagttttaaaatcaagcacagaagaattatgagagtacatataatcagaacagagttttttggaagaaaaagccggaaagctctgttttttgttgtacaaaagtagaaaaacaggtaaaataaaagaaaaattgtcgaaaacagaggaaaatgatttgaaagtttgtatgaaatgcaagagagcatttgaagacgaaaagaaagtttgtgatttttgtggggaaccactaattgaaatcagagaaacggatggagtaaaaaaagaaagaataaagaaaaatccaattgtatttgcagtggctggaattgcgatcgcattggtggcgggacttggaattggttcgctgacaatgaaacagcttgtaactggaaaaaatgaaaaaagtgcggtgcaaagccttgaaacagatgaggaaaacgtgctcggagaagtaaaaaaagaaaaaggtgtttcaattgaagatgaggaagaggaaacggacgaagatgaagtgccggaaattaaggtaggggaaacctggactgtggatggtctgtggaagattacgattaattcggtgacggagacggaggagagagatagctataatgatagagaaaatccagaagctgtttatattgtagattatacgtatgaaaatctgggatataaagatgagtactcaaaaggattaggctttgatttagacggagtttacagtcaaatcgtagattccgataaagagatgggctatcactattatatatcaaatcttaattcagttgagcctgtaccgataggggcaagaaagactgttcagacagcaataggggtgaatcataaaggaacattttctattttatatgaaagagatatagaagatggagaagatgaagatgagtataatactaaagtttacaaagcaaagtttatctgtgaagtgaaagagtaaggagagcaggagtatatttaagaggaaagagagaaagaaatatggcattaatggaaaagtacgatgcatttatcagctacagtcatgcagaggataatgcagagattgcggaggcacttcataaaaaactggagcattatcggattccttctcaaattcagaaaataacaggaaaaaagaaaatagaacgagtctttcgggataaagaagaattaccactttctgcaaatctcacagaaaatatttataccgcattagataattcagaatatctgattgtgctttgttccccggaatcacgggcatctcaatgggtgcaaagagagatagaatattttgcaggagttcatggaaaagagcgtatctttgcaatattaataaaaggagaaccggaagaggtatttcctccaattctctgtgaaaagacagaaataaaaacagatatcaatggtcaaaattacataattacagaaccagttgaaccgcttgcagcagatgtcagaggatattcaaaaaaagagaggataaagaagttggatgcagagtttttgcgtttgatagcaggaatcctgcagtgtccttatgatgagttaaaacagcggcatcaggaataccgaatgaagattgcaattgcagcaatgagtgcagtcatgtttcttggaatcgcatttggcatgtattcagcatatcaaaggaatcaggttaatacagcatatcagcagtcattaataaatcaaatgaagagtctgtcggaagaatcagaacgatatcttgatggaggagacaggataagtgcactaaagacagcacttgaagttcagatagaaggacagagcagtatttatccgatagtaccggagcaaatctatgctttaaataaggcactgtatacctatcagcgttcaagcaattatatttataagccagaaaaaatgaaaaccatggatggggcagtaacagaggtaaatggcttcagttcagatggaagtttgttttttgcacttgattcctttggacaagcttatttttatgatacagacacagaaaaagtggtatggaaaattaatgcagaaaaagttttcgaaacaacaggagaaaattttatctggggtaaatttaacggaaaccattcgattgtgatggcaacagaacattactttgtggcattggatgtagaaaaacaatcctgtggagcgattgcgaaaacaaaaaagaaaaatcaaaaagatcaggcgatggatttgtataaaaacaaattagcggtgtgttataaaatcaagaaagaaaatgccaaatatgacagtatcagtctgtttatttatgatatggaaaagggggaactttcagagacgtatgattacctttcagaaaaagaaacaaaatatatagctgagattgatcagattagtaaaatagttttttcagaaaatggaaattatttggcaatatcaaaatcgtggcgtagcctaagtggtgaggacgaacaaagtaaaatgatttctatttatgatatgaaaaatggagaaattgttcagaggtttggaacgaaaagtgttttagatctttgttttatagatgaagatgcagttgcttcggtagaacatagctcatctttatcgccatactataatggatgggaaatgcaggaaagtatttacagtctaaaagatggaaagagcttgtggcaaagccaaaagactagaataacagatacgatagcagtagataacccagccgctttttgtaaatatattagtaaggttaatacagatacgaatggagaaaaggcagaagtagttggatttagctgtgaaggaaatttgacattggtaagaaaaggcgattgggatattctatttcagaaagattttgaatatgatattgtggaaattcaaaagatagatgacaataatattttggttggacttaataatggaaccgtttatcgtgttatgacttgtagtttgtggagtaagatgttgattgtagatgctgatattagtgaagaatattacaacgcaaagatagataaaattgttcagctaaagtcacatgacttagtattctcaaaaaagatatttgatgaatctatgaaaaaagagggaacaaaacgaccagaacttggaaatgatgtaaccaataatgaaggagaaaaagtagttggaacaaagtacagggcagaagttgaaggtgattcaattattataacggacagaaaaacgaaagaaaccgttttgacaattcccatgtatcaggcagaagagatggtttacggattttttaataatgatgaacaatttttggtatataatgaacagtatgaggaaattgtagtctgggatatggaaacaggaagtattttaaaacagcaagaactggatttggaatccccggttaaaacacaaatcattatagatgaagatttgcatctctttgcattaaatcttgaatatggaaacatatcgtttacggctgaagaaacaccacataatacattagatcttttttattacgacgatgagtttaatatttatcggtatgcaagtattccttatggggatattgatttcaaaaataagaaactatatgtaagagatgggcaggattattattcgacatggatttacagttatgatgaactggtggaaagagcagaaaaaattttaaaagaaaaatagaattaatagtggcgaaaagtgatagtgacggagttttctggtttggcggaaagctccgttttttgttgtagaatttcagcaaggagtttcaaaatttgaaaaagatgggagagttgaaattgggagaagatggtttaataaagatagaaagtgaagagaaaccttattaaaatctaaagtaggaggaagaaagtatgtggattattataatttattatgttgggataccattaagtgcaattgcgggtatggcagttattttgtattatctttttggagaacatggagagtggataggaatggcatctaatattatggctttgtttatgttagttggggctgtaattggatttctttcatcattgcatgaattagtttatggtagattgattaaaggagataaatcagttggaattatggaaaacttgtttagtatgttggtatatggtggtttagcttttatgataagctgtttttttattagaaattatctcatgtaagcaagtgaaataacttatttgagagagattgcgtctcattttaaataaaatttgacgacaaaaatcgacacgtattgtgagaaaatatttaaaaaggtaaaataaaaagcaagaataacagcttaaagggggaatatttcttatgagaaaagaaaaagaactaagtgcaatgaaaaaattcatcaagaaaatggcaattgcagttcttacaggagcaattgcattttcggttgtacccgcaacagttcaggcagcaggatggaaacaaaacaagaatggatactggtggcaggaaaatgattacagttatccgaaaaatcagtggaaaaccatttatggaaaacagtatcattttaattcaaagggatatatggataccgactggacgaaggtagatggaaaatggtattactttggtggaaaaaatgatggagcgaagaagacttactggcaaaaggtaagaggaaaatattactggcttggaagcaatggtgtgatgagaacaggctggcaaaatgtatatggaaaatattattggcttggcagttctaatgacggagcaatgaagacaggctggcaaaaagtagggggaaaatactatttacttgggaaaaatggtgatatgaaaagtggctggcagactgtatatggaaagaaatattatcttggcggtgcaaatgatggttcgatgaaaacaggttggcagaagattggtggttcggattactactttggaagaactggggaatccaatgagggtgttttaagaacaagtacctgggttggaaattattatgtagattcatcaggaagatgggataaatataaaaaaatagatacaagtaattacatgttgaatggaaaatataaaaatttagtatcggatttgggaatgcaagtaatcgataaaaagtcaaatcgttataagaaggataaagtagagttatattggatgcctggagattgttttggagtgacaaatgaagggacaagttttgtaaatgtgtatggaattgtacctggagattccttgaatagagctagaagtatattagtaaataaaggttggacagaagttaatggatatagtagtaatagctataattatgtatttctaaaaaaaatagacgaaagacttcatatggtagaatttgatacgaattcacgtggaattttgcagaattggtatttgatgaattggccacaaggtgagtgggttctagagtattatagcatgaagtctgaaaatgcggtagtaatggaatcaccacagcaggaatctgatacaacagaaactgaaattccagataccgaggcaaatagcgaagaacctgcacttccagaaacaacagagcaggaaacttccgatgcgactcagaacgagaataatacaacagaaatagaagaagaacaggcaactcaggaagaacaagtttctgaagaagagtcaaccgaagagactcagcaagtagaagaaaataaagaagaaaaccagtcatcagagatgataaatgaataataaaatactgtccgagttaaagggggaaaagctaatgtattgtaataattgtggcacacaaatggcagatggagcaaaattctgccctaagtgtggaataaagatggatattcaaaatccggcaaatcaaaatccagtaaatcaaagcatgggaagtccaaatatgggaaaccagaacatgggaaatcaaattccgaataataattatcaacccaatcctgcacctgtttattatgcggctgattcaggtgaacttccaatgcgatggtataaatttgtgatatgggttcaattatttcttaatgcattgttaagcatagtttctggaataatgactatgacaggagcacattatcaaggacaggcaacagtggtttatatggtttatgggagcttgaaaggattagatattgtaatagggattatgatgcttgtattagcaggaggagcaatctgggtaagacagatgctgagtaaattccagaagatgggaccaactgcttatgtaattcttttagcttcaaatggtgtagtaaatttgatatatgcgattatggtatctgctattacaagagtgaatgcgtttagcaccactgtaatttctcaaattgtagcaagtattgcgctgtgtatttgcaattacatttatttcaataagagaaaatctatgtttgtaaattaatcaaaggagcatgtagagagtaaaatctttgcatgctgtttttgcgttcaaaatttcaaaaaataatttcaaaattaaaaaaatatacagtcaatgaaatcccaggaaaatgttttaataaagacagaaacaaagtgcaatgcgtcaaaagataataaagattgacgacaaaaatggacgcatattgtgaaaatgcactaaaaaagttagaattacattgatttaacagaaaaaaacacgaaaaggagaaaagtatgaaaaaacaagggattttgaaaatttttgaaggaatgatgttgattgcaactacaacagcgtgtggttcaagttcagcaggagtaaaaaacgttgatttaaaagacccagatggagattatcatgttcaggttgattttaaaacaaatgaagtaactctttcctgtgatgtggaaaatgatgatacgggaacaggcgaaggctggtctgaaattttaaaagcctgcaatagagagcaggattcagcaatcaattttgaaacaatgtcttttaatacaacttataaaatgtcagacgattttaagaaagtattcaaagatttttgggaaaatgattttcaaaatgaatactcaggggttgaaattaatgaggatggaacgacagcagatatagtggacctttgcagatttttagcattgggagaacagtgggaagaaaatccgaatttacttgttacagaacgtccggttgttgaagatggagcagagggagcagtagaagtatttgtaacgtatgatggaaaggaagaaaaatttcagaaagcagatacagataaagatggatacatttcagtacaggaatatattaaaatgatggtttcaaattatgaagaaaccataaaagaatttgagtcaatataaaaatagcagaaggggagttggtttaaatgaaaaaatcaaataaagcgttaagtatcgtaatttcaattatttatgcagctgttgctgttgaatggattatttcgattgtatcacaatatctgaagataaaaggtggtttttcacctgtagcagaaattttatattttgttccggcagtattgatgttaattattgcaggtctggaaatttatcgtttggtgaaaggaaaatataaagttcttgattcggtattatttttaattttgccatttgtaatgtgtatctctgcatttgtgcttgcaccaggtattgtggatagcaatggagcatatcatgtcagcatcataagctctgtgagtctgatgtattttgtaaaagatttagttgcaattgtagcagggcttgtggctcttgtactggcagtgattaagaagaaaacagaaaaataaaatgactgtaaatacagtaaatgcaatatgaaaaggaggagcacaatagatgaagaaagcaaaaaaacctaaaacgatgaaaatgcttatcaaaaaaatagcagttgtagcttgtgctgcaacgcttgcattttctatgatacctgcaacagttcaggcagcagggtggaagcagaacaaaaacggctactggtggcaggaaaatgattatagttatccaagaaatcagtggaaaactatttatggaaaacagtaccactttaattccggtggatatatggatactggctggacaaaagtggatggcagatggtattatctgggggcaagaaacgacggggcaaagaaaacttactggcaaaaagtgtatggaaaatactattggcttggaagtaatggtgtgatgagaactggatggcaacaagtatatggaaaatattactggcttggcggttcgaatgatggagcaatgaagactggctggcagaaagtaggaaaatattactattggctcggtcattacaatgatggagcaatgaaaactggttggcaaactgtctatggaaagaaatactatctgggcggagcaaatgatggagcgatgaaaaccggatggcagcagattggtggatattggtactattttggtggagtaaatgatggttcactcaagacaaatacctggattggaatttatcatgtggatgcgaatggtagatgggataagacgaaaagggtagatataggggagtatttaacagataagaaagatgtgcaattagtaaatgttctgggtttaattcagacaaagtcagaatatggaagaaaagaatatgcacgagatcaaataacttattattatcatgatagtggttctggtacttattctcacacatttggaattacgaatgaaggaaataaatatataaatatttatgggattgttccaggaaactctctgtatgatgcaagaagcatattgaaagccaaacaatggaaagaggcacaagagaattatagtggtgataaatatgattatttgttccttaagactataggaaaacggtcatatatgattgaaattcatactgattcttctgaaataataactagttggtatgttatgaattggccacagggtgattttacaagccctgataatttgaaagagatttcattggatgcttccttagataattcttcaccagtagtatttcagaattcagaagaaaataaagctagtgttcaggatgtagaagaaagtgaaaatcagaatgaatccccagttgtaattccagaagaaacacagggagatgaacagaatggcgagcagaacttagagcaggatgaaaataaagaagtagaacaagatacaaaagtagaacaggatgcagaaattcaggcagatgcagaaatttcagaacaaccttcagaagaatttcaatcagcagaaactcagaaaaccgaagaacaagtagatgaataaacttaagaacctgtggagagaaatctctgcaggttttttgacttttattaaagtatgatagtgtggtataataaaaataaatcaaaagagaataacatgatactaaaaggagttagaaatgataaaaaagcaagaacttacgttggaagaaaaagaagaaaaagttcgagattttcgtccaatagatgatgctttttttgaaacgctggcagatgatatagcattttgccaagagatactacgagttatattaagtgataaaaaattagttgtagaagatgtaatcgtacagaacagtaaaagaaatctgtatgggcgttcggtaagactggatgcattatgtacacttggaaatggaacaaaatgtaatatcgaagtacagcgatcgaataatgataatcacttaaagagggtaagatataatgcggcaagtatagcggttgtggattcccaaagaggggataaattcagagaactggaagacttatatgtggtgtacatttccgaatttgatgtatttcatggcggttatacaaaatatcatgtggacagtgtagttcgagagacaggaaaaaaagtaaaggatggtctggagagagtctttgtaaatacggagataaaagatggaaccgaactttcagaactaatgacttgtttcttggaaaaagaagtagataatccgaactttccggagttttcgaagcgaatgaaatttttaaaacatgaaaaaggaggtctggacgcagtgtgtgatgtaatggaaagatatgaagagattgcagcagaaaaagcagaagaaaaagcaaatattaaggcagtgaaaaacatgataaaagtatttcaggcaacaaagcagcagattttacagatatattcggaaaaagaatatgagcaggctgtgaaagaactcgaagaggaagaaactaaataaaaaaataagagacaaataaaataagtgataaagaaactaaaaggagttagaaatgggagaaaagcaagaacttacgttagaggaaaaaaaagaaaaagttcgagattttcgtccgatagatgatgctttttttgaaacgctggcagatgatagagcattttgccaagagatactacgagttatattaagtgataaaaaattagtcgtagaagatgtaattgtacagaacagtaaaagaaatctgtatggacgttcagtaagactggatgcattatgtacacttgggaatggaacgaaatgtaatatcgaagtgcaacgatcgaataatgataatcacttaaagagggtaagatataatgcggcaagtatagcggttgtggattcccaaagaggggataagttcagagaactggaagacttatatgtggtgtacatttccgaatttgatgtatttcatggcggttatacaaaatatcatgtggacagtgtagttcgagagacaggaaaaaaagtaaaggatggtctggagagagtctttgtaaatacggagataaaagatggaaccgaactttcagaactgatgacttgtttcttggaaaaagaagtggataatccgaactttccggagttttcgaagcgaatgaaatttttaaaacatgaaaaaggaggtctggacgcagtgtgtgatgtaatggaaagatatgaagagattgcagcagaaaaagcagcaaaagaggcagcagaaaaagcaaatattaaagcagtgaaaaatatgattcaatttaatatttcaaaaaacatgattttgacaaaatattcagaaacagagtatgagcaggctgtgaaagaactcgaagaggaagaagctgaataaaaaataagagacaaagaaatgataaagaaactaaaagaagtttaaaggaaatctataagtaagaacgatctaaataaaaattataacgtggtgtaaaacagtatgtggagaaaaaagtctttgcatgctgtttttatatttaaaatttcaaaaaatcatttcaaaatttgaaaaatatgaagatactgaaacttaaagaaaatgttttaataaagacagaaacaaaaagaaatgcgacaaagattgactacaaaatatgacacgcattgtgaaaatgcacaaaaaagctaaaattatagcaatatatcagaaaaaatgcgaaaaaggagaagcgttatgaaaagacaaatcaattttaggggggaggtaagcaaaataactccataaaagtcatagtgtagtcagtttgatttcaaaaagaaaaggagttgttttatttaaatgcgaaaaacaggaaaagcatcaaataatataattaagattgtgtacatacttttggcaattatatgggttgcagtcagtttgctattctttttggtaggcagtaatttgggttcagttggcaaagtactttattttcttccaacggttgtaatgctgattgtaattgtagtaggaattatacatttatcaaaagataattacaaaaccagagatgctgtagtacttgcggtattgccgtggatttttatagttgttgaatttgccgtgtcagtgagtcaggatgccagtagagcaagcattgaagtgttcatgggttctttctttcagggcgttataactggaatcgtaggaattttgatttttattgtgaaatacacaaaacaggatatccaggagaatgaaaaattaagcaagatattagataacatgatgaaggcagtatatgcaattgcagcagttatctgggttattttaagcatctttttattcacgagacttagagagcctgttataggtgcaaagataattatctactttattccattattagtagttttggcaattatcggaagtcaaatttatttccttatgaaagaaaagcatacaatgataaatgctttaattgttacagtattaggatgggttttggcaattattggattcatgaatttatcaagcagagactttgattcattaggaattgcaatgttcgtaggatatatgtttccggcactggcagtgggaatacttggaatagtagttgtagtgctgactgcaatgagaagaaaatacagtaaataagaagtgcggatgaacctgtggagaggagtcttcgcaggtttttttggcaaaataaaaagtgaagctcttcctgtgaagatttcttgtttgaatggcaaaatggaaaatatgaatataccttacgaggtggtcgtttagtagcgatgtttacagtaaaatttacgcctaccgcagcaggtatgagaattcaggttacacagcaggatggacaaagatactcttgaatagggggatatacaggaaataataacgtaaaaggacaagatattgaatatagagagcggagttttgtagatttacagaacttcgcttttttaaagataatacagaactgattaagagtttcaatttatacagaaaacagtttcaaaaagtggataaataaagaaaaatgaaattaatagaatatggtttaattaaatcagggaaaagaagacaagttgttattttcttattataaaatttttgcgtctgaaaacaaataaatattgccgacgaaaatggacacatattgtaagaatatagtgagaaaaggtaaaattaaaacaataaaatcgaaaaatgaaagaggaggaaaagaagatgtattgtggaaattgtggaacacagaatgatgaccgtgcaatgttttgccagagttgtggagcaaaactaaatggaggaggaagtcagaagcagcagcaatatgttggatttggaccgggtggtcaaagtacaggatatcaaagtatggtatatgaatcaaaaggaatcggaaaaacagcaatggtctctaaaatcgtttcggttgttctgtttgctattatagcgttatttttctttcatgcggctgatgaagcaaagtattcaatacgggcgtggtcttatgctttacagacagggaattcattgtcaagtaactattcaataatgggaacattttttatgataggggcaattggagaattgattgtacttgtattgtattgcatttcctggactaagattgacagcgttggtatcacagccagttgtatggggttaaggcaaaattatcagatatcagacatcacaagtgtcaggacattatttggaatttttgtatttattcatggaaattcaggaacgagaagaataattgtagatgatcctaagagagtacaggggattttagagagtatgatatatagagtttgattaaagagaaaaagattattgcagtaacggagttttgtaaatttgcagagctccgttcttattatcagaagaggagaaaaaaacatggatgaattatatgtagttgttttagaaattagtgctgaaagtgatggttattatgtaaaagaaaaaataaatgaaaaagtaattatggattcaccggtacatagatatgatggatttgagtttagaatattatctgctgacgatgaatttgtacaagcgttaatctatgctgataatccttatacaacaagagtactgggcttaaatgttgataatgcagggaaaaaagttggagtgttgtttgatagtccggtattgattgaaacagatggtgggtttgcaggggtattgtgttcctatgtttttcaggttagcagacattatatagacgtgaataaaatgtatactttattaggagcagatattaaaagtagaaaactgatgatagaaagttatgctggattaagagacaaattgctggagcaaaagagaagaatggaattttctgaaatgatgcattacatggaacggaataaagatttgcagagccatactttgagaatggttgaacatacaaaattgtatcaggaaaattttgtgagtaaatatgaatcaatgaaagctggaagagtaagctgcgaagaaagtatgatgttaatagtagcaaaagcttatgcagaagaaggtaaacacgttgcagtactgaactctggaaatccagttgaaccgaatggtcagatatttaagggatcagatacagaagaagagaaaatttgtcgtgtaagtaatttgtatgaggcgctgatatcagaaaatacgagtgagtattatattttaaataaagagatatttgaaaaaaatcagttcaatagtatgtttttaggcacagatcgggtactatattcgcccgccgtaatggttatgaaagattatgttggatatcgaccatcttggggaatggctacggaagaatatagagagacaccttattttgttgatgtattaacctgttcggcacctttcttcagtggtttgggatatattcttccagatggagatttagaatatttgttaaaaagaagaatcagaaatatttttgaagttgcaatcgaaaatggcgtcgagacgtttattataggggcgtttggatgtggagattttcataaccctgccagtacagttgcaagagcatttaaaggtgttctttcggaaaaaaggtatgagagagcatttgaagatgtaatttttgtaattgaaagcaagggagaaaatcgttcggatatagaggcttttaagacaatataaaggagcaaaatttgacagggcagtttttaaattgcaaaatttttgcgtctaaaaacgaataaaaactgccgacgaaatctgacacatattgtaaaaatatactaaaaaaaggtacaattaaagcaataaaatggaaaaataaaacaaagaaggaggaaaagaggatgtattgtggaaattgcggaacacagaatgatgaccgtgcaatgttttgccagaattgtggagcaaagttagaaggaagagcaggaggtaatcaaaatcagcagtggcagcaaaatattgattatagttatcagaatgaaattcctgggcaggtttcaattcagggaaagaaaaaaggaaaattgaaaattctgataccggctatagcagtagtagctgttgtgttgattttggtatttagtttaactggaagaagagggtataaaaaaacagtagaaaattatgtgcagggggcgctggatggagatatagagaaagtagtcagtgtaataccagagggctatatggagtattacggtgtggacagatcaacagtaattgatatggttgaggaagcacttgatgatagtgggctctatgatttattagatgaagactgggaattcaactatgaaattggagatgcagaagatattaaaggagcggaattacaggaaataaaagatgattgcagtgacagtggagttaaggtatctgctgcaaaatcggtagatttaaaacttactgttacaacagaagatggaccagaatctgaaacggtttccattccacttataaaggtagggcgtaagtggtatatcaatattgaagaatttatgggattattttattaaaacctcatagcaaaagcgaatcatacgaaagtaaaattgagaaaagaggatgagtttatgcaaagaacaaaaattggaatttcagcaggattgttaggtgcaggaatttattttacaggattattcagtggttatttgataccgataattttgacgttctatgtactttggtttgaagagaatggatggttgagaagaacagcagtaaaagccgtttcagtcatgatattcttttctatgattacattatttgtaaatttgtttccggatttcttaggaattatcagtagttttgttggaacttttggtgttgaattttattattcttcagtaaatagtttatttgattccatagttaaattgattgatttaatgagaaatattttgattttaatattgggattcaaagcatttggacagagtacaatttatattccggttattgataatttactgagtaaatatatgcaataaaagagaagggacagcagaagaagcaattgtagtagatattctgggaacatttacaattagattagagttatcggatggtaaaggaaaaaagctttatagtgcaaaatttctctgtgaagtgccatgattccatactattttatctgttttcagagtttcaaagaatgatttcaatttatcattaagcctataatgttgaaactttatcagcatggtttaataaagacagaaaaacaaaggaggacaaatgatatgaagaaatcagaaaaggcaatgggtgtattaattggttttatatatgtggtactggcagggggttggattgcttcagggattcattataaaagttttgcattaatgttgatgcagacttcaaagattggaattgtgtattatgtgcttcctccggttgcaattgtatttcttgcaggaagcagtttatgtgagctggcaaaaaataaaagtattgccttaaacgctattatgggtatcatattatcgcttgcaatctttggagcagggatgtatagttattccagattaggatatggaacgagagattatgttttgtatacagcaagtgcatacttaattatttcggcagttacgattagtgtatcgtttattttaatgatgttgaattcggcaaagaaaaaaatgaaaacgaattagaaaagcagaaaatgaaaaagacgtatgagaaaatatttcaagtgcgtctttttttaaagaaaatcataaaaaatagagtaaatgaatatacagatgaaggaatttgttttaaaatagataataagaaaaaatgaacaggagtgattaacgatggcattttgggatgatttggaaaaaaaagcaaccgacgcaactacgaatgtaatgtctcgggtaaagggcgtgtcggatactacaagattaaattcaatggtagcagaagaagaaaagcgaatcaaagacatctattttaaaattggacagacttatgtagcgttacatggtcaggaaaatgatgctgcatttgtaaacctgcttaatgcgttaaaggcatcacagttaaaagtagaacagtataagcaggaaattatggatatcaaaggcgtacgcagatgtgaaaaatgtggtgcagaagttcagaatggagccgctttttgtatgtcttgcggaactcctcttccaaggattcagccacaaccggtgaatgttggaagaacatgtaagaagtgtggggcaaatttagcaccgggagctcgtttctgtacaaattgtggaacaccttatgcggaagaagcatcaggaagtccaagcggaaattctacaggaaattctacaggaagcgctatgggtagtgctatggggaattcatttggaagttcaaagcctgtagaacagccaaattatgaaccacagcaaagggaagaatcggattcttatcaagagccaatacagaaagaagaacagcttcaaaaacaatgggaaaatcctgcaaaaaaagtatgccaggcatgtggagcggaacttggtgaaaataccagattttgtattgtgtgtggggcaccagctggacaagcaccaaataacgcagaacaaccacaaaatataaccgtaacagtgtctccggttacacttagtaaaccagagacacaggcagtacaaagtgaaccggcaagaacgaagttctgtacaggatgtggtgcaccacttgaagatgattcccttttctgtaccgaatgtggaaaaaaggtagactaaaaaagagataaagtgataacctgcaggaagaaatttctgtgggttatttttatgtaatgaagctgcaaaaatactgccgataaaatctgacacacattgtagaagaaaatgaaaaaagttaaaattgtaacagaaaagaaaaagaaagggggattttaaaatgcagaagtcgagtaaagtactaaatataataataggagtgctgtatgctcttttgggaatcatatggcttatttcaggaatctcttctttaggaaatgtgcagattctattaggaacgaatatactgacatatgtgtgcttgttccttccggtattggtagtatttgctattattggtattagtttgtatcgtctgaagaaaaacgaaagtacaggattgcttgctttattatgggtaatcgcatctgttataatgttttttgtaggaattgttttatataagcagtatacatcagatggaacatactttgaaacattgttttatacgctggcattttattttgtggcagtagagttgactgttcctggtggaattattattatgatattaacagcaataaagaagaaaatagagcgttaaattaagattatggattacaatgaactgatatcttgttttcaagatacgataaaaatgtcagaagatgagcttcaggatgcaactttagaagcaattgacaatacctgtgtattaaaagaaaatatctatgaagaagtatttgaaaattcaaatgtcaaaatagaagaaagaccagaagatgcggatgtgtttgttgaagttaatacgacttttgcaacagcaaaggaatatttgcaggatggaaaagtagcagttttaaattttgcaaatccgatatgtcccggtggaggagtacaaaacggtgcaatcgctcaagaggaatgtttgtgccggagtagtaatttgtattgttgcttaagagaggaaaaggtctttgaagattattatctatatcatagaaagatggatcattatctgagtacagacagattaatctacagcaaagatataactgttttcaaaaatgacaacagaattccggcattaatgcctgccagaaactggtttcaggtagatgtcataacttgtgcagcgccttatctgattggaaatgtaaatattgaccagaattcattaaaacgggtctttttgaaacgaatacagaacattttagatgctgcaattttaaaccaggtagatacgattattctgggagcttttggatgtggagcatttaagaatcctccggaccttgtagcacaggctttttatgaagtgatttatgactgggattataaaaaatattttaaacgaatcgtgtttgcaattaaatctaccaatatgaagtgtagaaatattgaaatattttcaaaatattttataattaaatcagtttcagaagaatgtctgataggggataaacagtatttcaaacaatggcagaaaacaaatccgtattttggtaaaaagttttcagttctgggagattcaattagtacattagaaggttgtcatccacagggatataaagtgtttttcaaagatgagatatgtaaaagaacgggtgtcgtaaaagaaaccgatacctggtggggaaaagtaatttgtttttttggtggagagctattagtgaataactcctggtcgggaagcagagtgacaatggttcctgaaaattctgaattatttccttctgcatgtagtgatgaaagaacaggttttttacattgggatgaagaagtgccggatgtaattcttgtttatttgggaacgaatgactggggatttggtgcacttttatccagaagagataaaagaaaaaagaccagacctcaaatagcaaattattcaagatatcaggaatttgattatgcttatgataatatgcttaagaaattaagacgaaattatcaaagtgcagaaatctggtgttgtacattaggtgtaacggaaatgtcttcaaatccttattttgaatttccttatgaatattgtggaatgaatatagaagcctacaatggagtaatcaggaaaaaggcaaagaagcataagtgtaatataatagatttgtatgcagaaaatcaaccttatgataccatagatggcacacatccaaataaggatggtatgaatactttggcgaaaatgatagcatcaagtatgttatgaaaagataaaaaacaataaaaaataatagaagaaaagactggtgaaacctaaaaggattatgatagaaagcgcaatgtatgaattaaaacaagacttaaaactatatggaaaaccattattgttaacagcaatggtacttgtggcaatgcagttgatttttcatgagttatgtcctatgaagatacttttagggattccctgtccaggatgcgggttgactcatgcctgtctggatattttgacattccattggaaaaaggcatggaattggaatccggcaggatttttgtgggtaccgtctattcttcttttattgtggatgcgatatataaaacagcatagaataaaatatgtatttgtttttttctggtttacagtcggtatgacactgctgaattatgtgattaattttgggaacattattgcagagtataaggctttgtgataaaatttctataaaaaatattatatttttgtaaaaaacaaatgaggaggggatctcaatgagatgcagtaactgtggtggagagaatgagagcggcgtaaatttttgccagtactgtggagcaaaattagagcaggaatcaaatttctcccaaaacgattttgacaagggtcaggcaggacaaacaggatatgatccaaactatagcaatcaagcagaatacagcaatcaaacagattatagtaataatggaggatattcaggacaggcaggatattatcaattaacagaatctcagcttccggaagaatacagaccacttaccatgtggggatattttggatatcagttattattctgtgttccatgtgtaggatttatatttttgttaattattgcatttggcggaacaagaaatgttaaccttaaaaactttgcacgttcttatttctgtgtgtggattataatggtagtattaattcttctgttctcagtaatcggaggcggttttgcgacgttattcagtcttggatattgatattattaaaagtagaggggatgtcccctctatttttcttcctcttgacagtaatcctcttacctgctatgatgtcaacaaagcaattcttaaattcaaattcaaatatatctttttattcaaaaatttttccaagattgtaaataattcaaattttagaagctttttaatgatttcaagcctaagacttcctcgttatatgtaaaattccgttaaaaacagaataaaacctcgaaaaaaatgcaaaaagtgtgaaagttttgtgaccacaaagtttgacacatattggttatttgttgaaaatttattaaaatagatgacaaataatgatattattatacatttttcgcaggagggaaaggctatgaacaaaagatttgtaaaaagactgctggtgttctttaccgtgttatgtatgacaatggcaatgacagtgccggcactcgcagcaggcagtggaactaatgccacaacagatgacccggcaaacggtattcttcaggtaatgcttgcctatgttgatgatgggggtaacagaacttactttagtgccggaacttgttttatggttaatgaagagtatgttgtaaccaataaacatgtatttgatttggatacaacagattctgacggagtgacacttcgtgacacaatcgtagaaacaatgggactgaaaagtctgaaaacaaatgatactcacttgaagttatatgtatttacaaacagagatacaaacgtagaggcaactgtagatgcaaatgcacagagtgaagaactcgactttgcagcattaaaactttcaagaaaaatttccggaagacagccattagtacttggtgacagtgattctattaaaccacaggatactgtatttgctttaggttatccggcagattcaattcagaataaacagtctaatacaaaagaagatgtatctatcacaaatggtattatctctaaggtaactgtaacagacaacgttgatattattgagcacacagcttctcttaataatggtaattcaggtggaccgcttcttaatgcagataatgaagtaattggaattaacgaatttatcatagggcagaaaggatattccatccagatcaatcagattaaagatttgcttgatacttttgaaattgcatacacagacggagcaacaggtgcttccacttccacttctaactcaaatgatgcagaagagacagaagaaccagatgcttcaacagaagaagaaaccacaggtgaggcagaagaagagaaagcaacagaaccggatgcagaccttgtaacagcacttcagagtgaaattacaaaagctaaaaaaattgaccagaaaaattatacagaagagagcgcaaaagttcttgatgatacaattggttctgctgaaacagttgcagcaaataaaaaagcaacaaatgaccaggttacaactgcaacaaatgatttaaagacagcaattgataatctggaagaaaaatccggaccaaacatgattatgattgcaggtatcgcagcagcagttgtagtagttattattgtaatcgtagttattattgtagtatcaaatggcaagaagaaaaaagcagcaccggctcataacaatatgcagcgtccaaatacaccaccgactcgcccacagccagctccacagcagcagccacagtacagtccggttgaccagggtgattccggaacgacattattaaattctggttcaggcgaaaccacattattaaatggtggcggcggaagtgcttatcttatcagaagaaaaaatggtgagaaaattatgattacttctcagaactttgcaatcggaaaagaaagaagaagagtaaactattgtgtttctgataatacatccgtcagcagataccatgcaattattacgaaaaaaggttctgattattatgtggctgaccagaaatcaagtaactttacttatgtaaatggtgtacagttaagcccatatcaggaaacactgcttacagacagatccactctgaaattatcagatgaagaatttgaatttcatttatcatagttgctaaatgattaagaacagtgtaggtgaaaaagatgggatttttaagtgttttacatagtgatgtaggaataaaaaagaatacgaatcaagattctgtcttaattaaagtggcttctacagactacggcgaggtaatgcttgccgtggtctgtgatggaatgggcggccttgccaaaggtgaggtcgccagtgccgctttaattaaggctttttcagattggtttgaacaagaatttccagaaattttatacaacaaaagaaccgaaaatggaattgacagactggaactggaaaatgaaatgaatcagcttgtacttgaagttggcgaaagaatctccagatatggagagatgtctcacgtagcaatgggaacaacggtggcagtgcttctgatggcagaggggaaatatcatatcttaaatgtaggagattccagagtctataaactgaatgagactggattaaatcagcttacaaaagatcagacctttgttcagaaagaaatggaccagggaagaatgactcctgaagaagcaaaagtacatccacagagaaatgtactgctgcagtgtgttggagcaagtgaaattattattcctgagttttcacatggtgaatacaaaacaggagaagtctatatggtttgttccgatggatttcgtcacgtcattgcaaaagaagaatttgaaaaacttatggagccgaaaaaaatggatacagaaaaggcactcaaagatgttgccgtttactgtaccgaattaaataaatcgcgacaggagaaagataatatttcagtcattctcctgaaagtatgctaggggataaatgaatgctggaaataggatcgattattgatggtaaatataaaatattaaataaaatcggccagggtggaatgagcgtcgtttatctggccatgaatgaaagagcaaataaacagtgggcaattaaagaagtccgaaaagacggtgtgaaagattatgatgtcgtacgtcagggactgattgcggagacagacatcttaaaacgtctaaatcatccacatctgccaagtattatcgatgtcattgacagagatgataccttcctgattgttatggactacattgaaggaaagtctctggaccactggttgaaaaaggatggcgcacagccacaggaaaaggtagtggaatgggcaaaacagatttgcgatgtattaggttatcttcattccagaaaaccaccgattatttatcgtgatttgaagccggcgaatgtaatgctgaaaccggacggtcagattatgattatcgactttggaactgccagagagtttaaagagacaagtatagaagatacttcttgtcttggaacacagggatatgcagctccggaacagtatggcggtcatggacagaccgatgccagaacagatatttatacactgggagcaaccatgtatcatctgttgacaggacataatccaagtcttccaccgtatgaaatgtacccgatacgaagatggaatccagctttgtcatcaggtcttgaaaaaatcgtattgaaatgtactcagagaaacccaaatgaccgatatcaaaactgtgcagagcttatgtatgcactggaacattacggggaattagatagtgcatacagaagaaaacaatcaattaaatggaaatcctttgttgcgtcctgcgcattaactgttgtgtcattggcaggaagtatcggatttaaagtagcagaatcaaaaacaattaagaatagttatgatggatacatcagcgaagcaacaaaagtaaccacgcaggaagagcgtgcagattattatgaaaaagcaattaaaatagatccagaacgagaagaaggatatttagaattgcttgatctgtttgtctatggtgcggataaaaatgaacgtgattttaatcgtgacgaaacagcagagatgacagcaattcttggatataaaggaaccggaaacagaacaaacgaaagttattttgaaagaaataaagaaggatatgacgagtttgctttccgtatgggagtgtattacttctattattatgaaggaggcggaagcgcaggaaaatcgatggcacagccgtggtttgaaaaagcacaaaaaggaacaaccttagatgcagacaaattacagcttgcggaacgttttgcaaagatttccggatattatgcttctttagattcaagtgatgagaccggatatggaagttctgcttcttatggtgattattggacagaccttaccaatcttacagatggagatatcagcaaaatagttaacactaagactgctgttgcaatttacgaagaactcattgcacgtattaatgaaaatgcagttgatttcaaacgtgccggagttaccaaagaccagatgatggataaattgtccaacaccaaaacaagacttgaaatgcttcagaacgaaatttcacagagtgatgaaacctgggatgaagtattagatagtatcagtgcagcggaacatcaggtaagcgttgcattttccggaagagacacacagccggaacagaatcaggaagaaggaggaaatacgaatggaaagcagtgaaagactgattgagttatatcgtatgggctttattatttgtctgtgccttgcagccgtatttttactgctgagtatctttttctttttcaaattcagaatccgtgatgtgtttgatttcttaagtggaagagcagagaaaaaatcggttaagcagatggaagaaaaaaatgcgaagacaggaaagcttcgtgatgactattatgcagaaccgctgagttcagaactctataagacgccaagcggaaaagttgtgccgacgatgtatccgcagacagaaccaatgaataccggaacagagccgacacaagagacacagactaaaatgagtcagactccgacacagctatcatcaaatggaagcgaagagacgactttattaggaagcggacaagaagaaacaactctgcttggaaatggtgaaaccggtacagaagaaaccacacttcttggaaatcagaatcagaataaagaagaacaggaaataccgggctacaacggagagactgctcttttaactccagagatggaaaaagcaatacataaacaacaagaagagaaaaagcaggaagagaaagaaaaagaagtcagacgtaacaagtttgaaattataaaagaacagatagaaattcatacaaaggaagtaatctaaaattttgatagaaaaaataaggaaggagtgaaagatatgaaaaatccaaaaagaaatccagtggaaagattttgtgcattactgcttgcatttattatggtgtttacactggtactgccggatggggcattgagtgtatcggcggcaggaaataattcggatgaagcgttaggagaacctgaagcaagtaccgagaaaacaaccgatgttgaatttacgatttttgaaaatgttcctacgacagaaaatccagataacaaagttgcaattcaagctgcagatttgcagattaaagaggcaggcacagataatgtagttgcaaatggacaatctgatgcaaacggaaaagtgaaagttaaaaatctgacttatgatacagaaaaaagttatgaatatactgtatcaaaagcaggatatcaagcattagaaaacaaatccatatcaattggaacggtaaatgaagtcgaagttacattagaaatgagtgacattagtttaggagatttatcagctgtagaattatctccaaataaagaaggtgttccttctcaggttcaagcagttattaataacaaaattgataattttgaggttggaggagcagcacagtataaatgggaatcttccaatccagcagttgcagatgtagatggaaatggtttaatcactgctacaggaagaggaagtgcaacaattactgtatacagaaatggaaaaagtgctcagacaacgataaaagtaaaagaagttccgtcaatggaattgaatgtaactccaaatacaggaactgatgttaaaagtgttactatgacagtgactatgccaaaagatgcaaaaggcggaaaagtaacattttcattagaaagtggagaaagttatgaagttgctgttaatgaggaaggaattgcagaacaggttctggcgaaagatttaataggaaatgtgaaagtcagtgcagcgtattctggaaatgaactgtactttgagaatagtacagaagaaactggaaaatataaacaaaagaagcaaatttctctgacagctgatggtaagagtgaagcaagtattgattatggaagtgacttgccggtgctttctgtaggaaacgcagaagatagaacagtcacattttcatcttccagaccaaatgtaatagaagcaactccagatggtaaattaacggtaaaaggggaaggaactgctaaaattactgcaacagcagcagaaagtgataattatacagaatcaagtgcttcttttacaattggagttaatcaaaagccaattaataagaagattacatttgctgattttgaatggaatacaacaagtgcttctaaagtatatgataggagtagaaaaattagcattactggtactttaaaaagcgatgaattagtaggaaatgatcagattacagttacagtaaatgctcagttggaaaaatcagatgtaggaagttattctaaatttactgttatagatgatgattcagatattaacttaaaaggtacaaataattataagataacgacagacttctcaaataaaaatgttcagttagcagaaggtaaaacggttaatattactccaagaccagtttatgttaaggtggcagtaaaagaaggtaagacaacaaaatttgcgtacggaaaaagtaaagcatatttacagaaagctgtagaagaaaattatgaagtggtacttgcgggtaaatatgaagatggtaatatacttgagccggataaagatcagggactgcttccaccagctaaacttgaattaaaaaactatgcagaagtagcgttaaaaggttttaatgataatgatactgtgtattatgtaggaagttatacagcagaaataattcctgttataacaaacaaaaatgccggaaattatgaaattagagtagattctgaaaatattgcaaaatacagttcagatcttacgattgaaaaagaaacacagactagtttaaatgatttagttgaaattgttggtgcagatggaatttatcaaaatgagaaagatggttctgtatatataagaggaaatcaggcagcaacattaaaactgcaattcaaagaaacaaatgcatattatgaccagatctgggtttctaaaggtgaaaaacaggctgatggtcaggaaatttattacgatgccattaatagtggaatcagctttgatgatagcaaagataaagagtacactttgaaagtttccttaagaaatagtaaaaatgcattaacagtgacagatggtgttgaatatcagaagataacagtagatgccaccagtccgacagctgattttaaagacttaggaaatgcaggacagtttaataaagtacttccaaacgactggaaaggctttgggaatttttcaaaggataagacaaaagaatatcttgttacttctgatgatgctaccagtaaagtaaagagtcttaaaacctgtaaaattacagtggataatgatgaggcagaagcaattgtagagaagatttcagaagcagttaagaatgatagtgtatgggaagaaacaagtagtgtaaaattcgataaggaaggaaactatattgtacttgcacttgtagaagataatgttggaaataaagcggtttatgcatcaaatggtttggggtttgatttaactgcgccagatgtttcggtcaaaattattgaaccagaagaaaacactggatataatcaaaaagttaattttacagtagagataaatgataaagatattacgtctggtgttgatgaaattgaagttatagctatggattcagataaagatgtgactgatgaatatatagaaactgtaaaagtagcaggtggatttgatgaagataataaaatagttatcgactcttgtacacttaattcagagaaaataaatacaattgttgaaagtgaacaggatggaacacttaaatcaattcaagcccatgcgaattttactgttaatggaaaattgtctatcaataaatatcagtcaggatatgcaattgtaaaagtaattgtacgtgataaagccggaaatagtaaagcgataacaacaaaaagagaaaaggtagatgtagttgcgccaaaagtaactgtgaaatatgataaggattcggaaacttcttatattcagagttcagaacgaacaatgacaattacttatacggaaagaaactttattgaatcgggattaaggtttgatgtttcaattaatggaacagaaccagatgttcttacgcttaatgaattagaggatcttgaatgtgtaaaagaagtaaaaaaacctgttaattcaaaaaatgagccggatgactatacagacgaaagaacaaatacttatgaaattacgttttcaggtgatggggcatataaagtgattccgtatataaaagatgctgctggaaatgaaaatcaaggtattgaatatgcggatattaattcaaaagcaaatgaactgttcattttggataatacagcaccaacagtagatgtgaagtattcaccagaaaaaagtgttagagaaaacgaatattttaattcaaaaagaacaatgacacttactattacagaacgtaattttgataaaagtacattgaagtttgatttgatatctgatggtgaaacaaaagcagggttaacaaaagaagaacttataaagaatggcttagttataacaacaaaagatacagagtcaaaatttaatgaggaacagcatactgatgatagaaacatagtttatgaaattgaatttaaaaatgatggtttttatcagttaattccttatttaacagaccttgctggaaatgaatatgagggtttagctgaaagtgaaataacaaaatatcaagaattctgcatagataagaataagaaagcacctaaagtaacagttaagtataatgataatgataacaaactgaaattgcataatggtaagtatttcaatcagcagagaattgcagaagtaacaatcaaagagcgtaattttaatgcggatgatttagagtttactttaactagagatggagataagcaaacatataagggattttctgcattagagcaggcaattggtaagttgaaggattgtgatattacagaaattaaagacagtgaagaaaaaactgcaaaacaaaagcatacagatgaaagagaacatacattttctatcacatttggtaaagagaaagaggatcatgactataaaatttctgtaaaggcaacggatcttgctggtaataataatgatacagttaaagatgagaatataggggctgagacggttgcaacaggagaagagtttactgttgatatgctggcaccaactttgacagttaaatattatgtatatcaagatgaaaatggtaatgaatcagatgagaagaatgaaattgaaaaagatgagattgattctggagagtgttataaaaatgcatctattcatgcagaagtaataattgatgaacgtaacttttctgaagaaaaaaatggaaaagatagttttgcagagaaccagataaagcttgactattctgctaagacctatgatggaactgaagttaaaacaaccgattttggtgatgtagctaaagagagagaaaattggaagcctaaccaagagaataggaaagataatattgaaatgctcaatttagaattttctgaagatgcaaattatactttaagcattacatacaaagatcttgcgggtaattctatagatcctatgagttataagtctcagtttactgtggataaaactgcaccaactggaaagattcagataggcaaagatgaaaaagatgtaggaattattggaaaagtttttgattttatatattcatttttcacgaataataataaaacagagattactatggtaggaacagatacaatgtcaccaatagtagaacagaaatattatattgagaaaaatagagatataaaaaatggtaatacgggttatgaaagattaagcctagaagaactaattggtaaaaaagaatgggttgatacaaaaacaatagaagaaaataaagaaaatatagctacaagtacatttaaaatattagaagaaaactctaaggcaatcccatatctatatataaaagataaggctggaaatgaaacttacgtaacatctgatggtgcgatttacgatgatgaaaaagaaggaactcctgaaattcaaattacgacagatgatccaatatcttgggaaggcgaaaagaatgatataggtctttttaataagaatgtaacttttaatattgtggtaactgacccaaaagtaaataaaacttattcaggtatcaataatgtttcttatagaatttataaaaatggtgaatccgaagatgtaaaatatatttctctttataatgaaactatggacgaaccgataatgaaacaagtttttacttctgaagacttagtagttccatcagaaaagtttaacagcaatgatgttacaattgaagtaactgctacagataatgcgggaaatactgaaacagtaacaaaacaaattgccatcgataccacctcgccagaaattacagtttcctatgacaacaacactgtcgcaaatggtaaatacttcaaagcagatcgtactatgacaattgagtacaaagaaagaaactttgatgaaaagggacttacgtttgatgtatcaacaaatggtagtttattacagggaatttcattagacgaattaaagaaacttaaggataagggaattatcgtacaatcatttaatgctgctgatgatgatactgaatcgggtaaaaactttaaggattttacagatgaacgagttaatacttataaaattctctttaatgccggtggcaataacggagatatggattactcgattgttccgcacataatcgataaagctaataataagcagaataaagagacacagtataaagctggtacagaagctaaaacagaattcaccatcgataaaaaagccccagtcatctccatggcttacagtgcagagggtgaaacaatcaacccaggcggaaatgaagtttccagagtttacagaaacaaaacaattacagcgacagctaccattgaagaacgtaacttctccaatagtaatagtttttcagaagatccgaaacaaatgaacctcacctatagtgcaaagaacttccaaggttccgacatcaacaccgagaactacacaggcacagcaaacacaagaggtgaatggagtaccaacgtttacaccagaacaaaaaccttcacattctctcaagatgccaactacaccttaggtcttgtttacagagaccttgccggtaacgaagcagtctacgatacacgttacttcacagtagataaaactgctccaaccggaagcatgaccatcgaggataacagtggaacagccaagacctggattcagtggattcagcaggtattcttcgatatcttcacccagagccagaagggtgtatccatgacaagtgcggatgaaacagcaggtgtagcaagtacacagtactacaagtatcatccggattcagagagccgtcatacttttgacggtttatcaacacagaacttggattctatcagcagctggtctgatggatacagtacatctgttaatgcagatgaacaggttattgtatatgaaaagattacagaccgtgcaggaaatgtaacttacattaataaccaggaaggtgttatcgcagataatacttcaccgactgcaccggaaattaagattacggcagcagaacctgctcagggaatctacaatgcaagtgttccatttacaattgatgtaacagaccctgaaaatggtggaacttatgccggattaaaagaagtttcttatgaaattacaaacaacggcaaagtaacacagagtggtaactataacagtgatttatctgacccgacagcgagagtacataacattcatcgttctgaaacagtaaatgcagaactcaataacagcaaccatgtaacaatcaaggtaaaagctgtagactatgcaggaaatcagtcagaggcaaccaaggatttgaagattgatattacacatccggaagttacaatcacatttgacttaaataatccgctgaatggcaagtattataagacaacaagaacagctaccgtttctgtaaaagaacgtaactttgatactaacgcagttgatttgaagattacgaatacagacggaacaatgccttctgtaagtggatggagtatcagttctcaggctggtgaatccgatgatgcaattaatacctgtcgtgttgagttttcagcagatggtgattacaacatgacaatgcagtgtaaagaccaggcaggaaatgaatcaaatacagtaaaagtggatgagtttaccattgataaaaccattccggttatttctgtatcttatgataataattccgcagcgacaccgggatattacaatgcaaacagaacagcaacgattacaattaaagagcataactttaatgcagcagaagttaattcacagattacagcggctcttcagggaagtggtatttccgcaccgggcgttggaggctggagtaacagtggagatactcataccgcaagtgttaccttctcagatgatggagattatacctttgatattgactatacagaccttgccggaaatgcagcagcagattatacacaggacagtttcactgtggataagacaaaaccggaagtagagttctttgatatcgaagataaatcagcaaacaatggagttgtagcaccgggtgtgaagtatagtgatgtgaactatcttgaaagtggcgtagagattaagattgagggtgcagagcatgaatctaaagaactcaccggaagccgttccagtatcgcaaacggtgaaagtattaagatgaatgactttgagtatacacaggataatgatgatgtttacacaatgaccgcagtaatctcagataaggcaggaaacaagacagagaagaagattatgttctctgtaaacagatttggttcgaactattcgttctcagatacaacaaaagaattccttgatgaggtatattctaattcagcaaaagaccttgttatcacagaaaccaatgtcgattcactggtatttaacggaatttcttacagtctggataataagacaacagaactgaaacagggaacagattataccgtgaaagaaaccggaggcgaaggttcctggaaacagtatacttacacaattaagaaagagaactttgaaaaagaaggacgttacagtgtaacaattgattcagaggataaggcaacaaatacaatgaataacaaagtaaaagaacgtaacattaactttgttattgataagactcctccaactgttgttatcacaggtattgaggaatccagctatcgtgcagacagcagagatatgtcagtcaatgtatccgataataccgctgtaaaacgtctcgacatcatggtagacggaaaatctgtagcaacctatagtcaggaagatgtaaaagaagccggaggcaaaattgtttatacattgaacagctcaaacagcaaacagaaagtaaaagctgttgcggttgatatggcggacaatgaagcaacttctgataatcataatatcctgattacaaccaatctgtttattcagtatattaataataaacctcttttcataggttctattatagcgttagtgctgattgcaggtggtgcaatttacttctttgtatttagaagaaaaaaatctgaagatgcagcagatgcaaattaattagaaaggatggctgtctgaatagaaatatttgggcagccaactttttaaccagagtatgtattttgggcgtctgtcttaaagaatttaagacaggctccgagagtacatcaaagaaatttcacgaagataaaagaggatttggcggggaggtgatttgatatgcttcaaaatggagaaatacttggcgggatgtatcaggtcattggtgaaattggtaaaggtggttctggaattatttacctgggatatcacttacgacttcaaaagcagattgtgattaagaagattaaagatatcaatgtcggacagattaacaccagaatagaagcggatattttaaagaaacttcatcatagatatcttccgcaagtgtatgattttttagagatgcaggatggaatctataccattattgattatattccggggcatgatttgagttattatctggggcgaaactataatttcccggaagaaacaattttaaagtggatgcatcagatgtgtgaagtgttggagtatcttcattctcagaaaccaccgattcttcatagcgatatcaaaccgggaaatattatggttacggaaaatgatgatatttgtctgattgattttaacgtttctttggatggtgaagtatcaaaggagcttcagggattgagcagaagttatgctgctccggaacagtttcaatatgccctggatagaatgtatggaaaacacagcaaaatagtattagatgcacggatggatatttatagtatgggggctgtgttctatcgactgatgacggggtggacgccagatgcagaatcaggaatgccatattctattatggagatgaatcttccctacaataatggaatcaaagcagtgataaacagggcaacggcatgggaaccatcacatagatttcagtcagcaaagcaaatgagaaaggctttggacaatgtggaaagaatggacccacagtacaaggcattaacgaatctgcagattcttacagcttttggaagtggtttgttgatgctttttggtatctttttaatcttgtttggaacaatgtcaaataaaaaagaaaaatggcaggaagcttatgattctttttatgaaattacagaatccggcacagattccgaggttgtcacagagggaattgatttgcttaataatggttccgtacagggggcactaaaaaaatatccagagaaaaaggcggagattcttcatgcaatcggggatagttatttcagacaaaagcagtatgaagatgcaatcgattattataaagaggcacttgatacaggagaagtccaggaaaattatttaagagattatatgatggcgctggcaagaagcgggcaaaatgtagaacagtcagtgattgaaatagaatatccggaagcagcctatatggagcgggcagatgtggagttgatagaggcgcagacaaagtatacacagggtgagtttgaggaagcgctaataaagtgtgaagatgcattagcacaaagtacggatatagaagtcagcagtctgatttgtgtcttagagtcagaaatctatacggagcaggaagagtatacgaaggcggcagattcagcaatacgagtcaccaaatttgattcatccaaagatgcaagaagacgagcaggaagtcttgcttttgaagcgggaaatcacttagaagatacgaaagaaaaaaatgggtggtatgagaaagccaggaaatattatgaaacgctttgtcaggatgagacgtgttcgtatgaagatgaaatgaattacgcactggtacttcaggctctggagcagtattcggacagtaatgtctgtttaagaaagatgagagaagaatatccggatgattataaggtactgatgtggatgtgctataactatctgggaatcggaaatcaaaagggcagtatggctgaggtggaatctgatttgaattttgcatatagttcctgtaaatatttatattctcaagatgaaagtatgacaggtggttcagatgaggatatggaaaaattaaatgagttgatgaagcagttggaagaataataaaaatacaggaggaaattatggcaggaaacgttatgatagttgcaggcggcatactgatagtcgcagcaatcagtattatggttggtgtgaatatagtgttatcacgaaaaaaaaggcggataaaggaacagatttattccatgtatgagtaaagaacaaagaaaataaaaggatgagggaggacagcaaatgaagaaaaaaggttatatcatattgagcgtgatttgtgcagttgttttaattgcaacaggaattattctgggtgtagttatgaaaaagcagtcaaataaaaaaacatatacggcttcgattaaaacagcggaaaaatatctggaagcgggtgattatacacaggcggttgtagcatataaaactgcaatcgaaaaaatgccggaaaaagaaactggttatgtaggacttgcaaatacctatctggaacagggggatacttcttctgcaaaaattatcttgaaaaaaggttatctggtcacaaactcttccaaaattcaatatatgttgaatggaatcgaagatggaagtctgcttgtgaacaatctgaaagaaacacctaagaaagaaacgctccaaaagagtggagaattatcatttaatcaaaattttttccaaaagttagagagttttacctatcaggattatgaaagagaatatggtggacttccggaaattgtaaaagtaaaaaatggagaagttgaagtggtacataaaaatctttctgcaacttgtttttatgcaaatacctcagaacatggagatgtagttgatacaaaaactgatacaccggataaaaccggtatgccggaaaaaattgtagtggatgatatttctttattattcaagaattttacaggagaaattacaattgatgaacttcagagcatttgcggttccaaagtagatattgtgaataaaaaagagcgcagttatgtggaatttgagtctggaagtgctttgattcgaattgaaagcgatgaaaatggaacaatttcctcatctacggcatggaatgagattatccttacaaatgcgaataaaaaccggacagctaagaaaagtgtattttctggaattgtattaaatgcaatgacaagtgagggtgtagaggctgcaaatattagtttagaagcgcagggagattccagtcattcagcgaatataaagacggaaatggatggttcattttcaattgaattagaagcggatacctataatattactatcagtgcagaaaattatgaagaggaaacatttgaatttacaatagaagaaaatagtaactacagtggagagcagtttacgatttcaccaagtctggcaagtggaagtgcacgtatcgtgcttgaatggggagattatccggaagatttggattcttacttgataggtacgacggacgatggaacagaagtggatgttagtttccacaatgaccaatgtacaaaaaatggagaagtaattgcagaattagacgtagatgaaatggatggtcatggaccggaaacgattaccttaaataatttaaacggaacgtatcggtatttagtagatgattttacagaatcaggcaaattgcaagagtatggtgcgactgtaaaagtctatatttcaggtaagagtcagccggaagtgattacgatagctccagatgcaggtgtaaaaaacgtttgggaagtatttgaacttgaccatgggaaacttaatattttgaatcgtgcagcagtagaggattatgaataaagaggcttagtttatgtggatggtattggttatgctgattattgcactggcattatcagggatttttctgtggattaaatacagcataaaaaaatcagaggaaaagaaatattatgatgcggcagcgaggatgattaaagaaaattgtctgaataaaatcatacaaaaccgtgggcagagaaggcagacagtgacagataaattaatgatttatatcagcatatcaggaaagtccagacagggatttgtatttgacccggagaatgggattcgtattggaagaaacattgaggaaaatgaaatctgtattcgagatgcacttgtttcaagcagtcattgtaatatctacctgtatcaggggcagccgattatacaggattttaattcagcaaatggaacatttatcaagagaggattattcgataaacatccggttgatggatgggaatatatctattcgggagatacgctgttgataggggatacgaggatacagattaagtttttcttatttgatatgatgagattataaaagcaggaggacgacagaggtgatattgttaatttacaatcagaaaatgtgcagggagattcttttgcctaatcttcgagattctgattatgcgataagcatatctggaaaagcatatggattacgacaggatatccgactgcttttggagattacgggggttacctggaaaataaaagcagatgaaacttatcagttgcgaaaatcgggaatattttgtgaaaatgtggttcttgaagaacatgaaaagtttgtaatcaggacaaaacgaggagaagagctggagttgattgtggcagattcgggattgggctttttgacgttaggaaaatatgattttcgtcagatgagtcagatttcaatcggagctgcgccgcaaaacgaaatttgttatgagtttgaaaatttgatttcctcttatcacgcagaatttcagagacattcggacggctggtatgtggtggataaaagttcaaatggagtttttggaaagaatggaagaatcggtggaacctacagacttaattttggagagcatcttaatttatttggacttcatattatttttcttggaacgatgcttgctgttggtacctattatggtgaattgaaaatcgatcaggagcgattaaagcgatacgattttaagaatcaggaaaataatataccgtcaaacaaaacggatacggaagaaacggatacctattttaatcgttctcccagagatttttcctctttgtatacggaaccggttgagatagagggacctcctgccagaaaagcagcaaaacaaaagccctggtttttagttgtgggaccatcatttacaatggcaattccaatgcttttagggtgcggtcttgcaatctggggttccggaatgagaggaatggcatcgggagcttttatgtataccggtttgattacggcagttggttcttccggacttggtgctttttgggcggtaacaaatctgaaatatgcaaaacaggaagaaagcagtgaagaagaaaggcgtttcaatgcctatagcaattatttaattgatattacagaaacaattgaaaaaaagtataaatacaatgcagacatcatgcggaaaatgtatccggaagcgcagacttgtgccggatatgacagttctaatattcatctttggaatcgaaattacacgcatgaagattttctctttcacagacttgggcttggagaacttccatttcaggtgaaaattgatgttccgaaagaaaaatttacaatggatacggatactttgattgaaaaaccacagatgatacagaagcaatttgaaactttatatcaggttccggtaggaatttctcttttgaaaaaacagttgattggtttaattggaggaggaaataaaagaggagcgattgaaatcatgcattccattgttgcggaaatagcggcttctcactgttatacagatgtgaagtttgtttttctttatgatgaggaagaagacgataaaaaagtatgggaatctatgaaatggtttcctcatgtgtggtcagaagaccggcagatgcgatatatggcagcagatgaagtagaaagaagagatgtcttgtttgcattatccaatattttaagggcaaggatacaagatattgataatcggaaaaaaagagcaattccaaaaccatattatctgatttttgtttcaaatccagcactcttagagggagaacttctggcgagatatatttatgaaccggtaccggattatggaattacgacatttttaatggcgcagacagtctcacagcttccgaatacctgtgaagaaatgatacaaagtgataagacatttgaaggatattataatcttcaggaaggtccgatgcagagaaaaccgattcgtttagaccgtgtttccaatgacagtctggagcaaatggggcgcaggctgtctggaattaaggtaaacgaaatagaaacaacaagtgagattcctcagagtctggatttcttttcaatgtatggagtgcgaaagctggatgactttatagtggaagagcgttggaagaaaaacagaacttataacagtatgaaggcattaattggaaagaaatccggaaatgcagactgttatctggatattcatgaaaagtatcatggaccgcatggtttgattgcaggaactacaggttctggtaagagtgaaactttacagacttatattctttcgctggcattgaattttagcccggaagatgtatcatttttcatcattgactttaaaggtggaggaatggctaacttgtttgatggtcttcctcatatggcaggacagatttcaaacctttcaggaaatcaaatacgaagagcaatgatttcgattaagagtgagaatctgcgccgtcagagaatttttacggaaaatggtgtaaacaatattaatctttataccagattgtataaaaataaagaagcacaagagccggttccacatttatttattattattgatgaatttgcagaactcaaaaaagaggaaccggacttcatgcgtgagttaattagtgtagctcaggtaggacgaagtctgggagtgcatttgattttggcaacacagaagccgagcggaactgtagatgataacatctggagtaattcaagattccgattgtgtctgcgtgtacaggacaggcaggatagtaatgatatgcttcataagccggatgctgcatttatcacacagacagggcgtggttatcttcaggtgggcagtgatgaaatttatgaattattccagtccggatggagtggtgcaccttatgaagagagtgaggatggcgcagatgtatcggtatccatgcttaccagaacgggaaaagaggcacttgctgcaagtcgtcttagacgtttaagaaaagaagttaataaaagggatacgcaggaaaagacgcagctttcggcaattgtagaatatttaaaattaaaagcagaagaactgggctatcaaaatgcaaggcagctttggatgccggttttagagaaaaatattgtgttatcagaactggaaacagcagatagatcagctttggataaaggtgagaaatggagtctcgatgcggtagttggtttatatgatgatccgcagaatcagcagcagaagcctcttttagttgattttgcacagaatggaaatcttgcggtatgtggttctgttgtgacaggaaaaagtatctttatgcagacgatgctgtattcactgtttcaaaaatataatccggatcaattgcagtgttatatattggatttcagcagtcatttaatgactccgtttgaatcagcaccgaatacaggtggaattgtatatgacaatcaggaagaccggcttggcaaatttatgcatcttcttgagaaaatgatggaagagcgaaagaagctgtttgagggaggaaactatgcacagtatgttcgggcttatggacagaaaattccggcaattcttgtagtgattgacaattttggaggttttcgtgagaagacacggatgaaatatgatgatattattctcaaatatgtaagagaaggtaccggatatggaatgtatctggcagttacggcagcaggatatggaatggcggagataccgggaagaattgcagataatatacggactccaatctgcctggaacaaagtgatagattccgatatatggaaattttaagaacaacaaaacttccggtgtttccggaagccggaataccggggcgtggactggcagaagtagacggaaagatgttggaatttcaaactgcattatcggttcaggcagatgatgattttggaaggggcaggattttggaacaattcagcaaagaaaaatcagctaagtggactggaaaaagaccacttccaatacctgaaattccggaaaatccaattcttggtcagttggaaaaaatggagaattattcaacactggcagagggaagaaatcatattccatttgcttatgaattagaaacagcagaagtatttagcgtaggacttagagaaacctattgttatacaatatcaggacgtgcacatacaggaaaaacaaacgtattaaaactcttaatgtatggagcacagaaagcgggcggaaagctatgtgtaattgaaccgggacagaccgaactaaagaaaacagcacaggaatgtggagcgcaatatcttacagataccaagacggtatttgaatattttaaagaactgacaccgacgtttgtagcaaggaacaagaaaaaacgggcattgatagaggaaggggcagatgaagaaagaatttacagagaaatgtattcagaaactccggtctatatctttttaagtgatttgaaagagttctttaaattgatttacagtgctgatgcagaagtcggaaacatgtctggatttatggagacaattatggcaaagggaccgcttcacagaatttatttctttggatgcctgaaagtagaagatgcaatatctttgatgtcttataaagcatatcaatcttatatttcttataaaaagggaatccatttaggtggaaatttaagtacgcagaaaatatttaatttccagaatataccttatgcagagctttccaaagcaatgaaaaaagggtttgcttatgcggcagatgaagaagatgaaacaataggaattcagatcgttgtacctcttgcaaggagggaaaacatttgattggaatgttgatttcatcaatgtcagagaaagaaaccggatatatctgtgtgcgggcaaaagatatgatgggaagtatgagcgatgaaatgcttgaaatacataaatgccagacgatagagatgctgaaagagcttgttgagtctggtgagaaagcagatttagcctgtattgacattacaattccagaagcattagaacttactaaattatttagaagtaaaaatgaaacggcatatatcatattgattgcaagccttaaaatttctccggttacttatatgaagccgtctattcgtgctgaatccttgattttaaaaccgtttcagtcacaacaggtagatatggcagtgaaagaagcaattcaggaagtgcttaaaaagtatcagaatccagatatagataaggtgtttgttgtagataatcaagaaggcagagttttaattgaatacagtgcaatttattttttcgaagcaagaaataaaaaaatctatttgaatacaggagcaagagagtatggattttacagcacaatcgagcagcttcaagaggaattaggggaacagtttatcagatgtcatagaggatttcttgtaaaccagaaaaagattgaacgagtaatattttcaaagaatttgattcttttagcggatggatatgagattccggtttcacgtacgtataaatcaattttaaaagaatttcgtacgagtgtttgataaagaggagaaaaatgtctgaatatgagtatgcagaaagtggagttttgctgacttttcgggagcttactttgcttcttcaaagtgtgggagtaagatacataaacggtttttgtctgtcggagtctgaaatttccgatgaagaagtaattcaactgataggaagtctggttcgaaaagggattctaaagacttctgacacagaattttatatggaagatatggttgaaaaaatgattcgctgtattgggtggcctgatgaagattatgaaattgaacaggaaaatggacagatttattgttatgaaaaagaagaatatgcattggttacaaaaatctatccggtgagagagaaaactctggaacttattttatatagtaaagaagagtttcaacagaaaatcagaaaggaggaaattttgtgatactggtggatgttgaagtgcctgtgatgggaaagacttatgatgttcaaattgatgaaactgttccggtaaaagagattgcagggcagataagagatatgatttgtctacaggaacaatgtggaatcctgggcgggcaggaaaatctgactttatgggatgttcaaaggcagcaatgtctgatgggagaacatacagcaaaagaatatgaaattacaaccgggacaaggcttatgttggtataaacatggttattggtcagaaaatcgtgtcattcgtcagagatgtgtaacaaaaatagaaatcagtgataggataacattaacaacaacaaagagaaaaaaataagaaaaattggaggtagaaacatgggacagatggtaattggaaccacagaattaaaaaataaaattgaagagcttcgtgcattaaatacccagtttaaaagtgcagtaagtgagttggaaaatacagaaggtgctttaaatggaatgtgggaaggcgatgcaaaaaatacttttcataacgcatttatgagtgataaacagcagatggataatttctattccacaattgagttatatgcacagaagctggaagtgattcttgcaaaatatgtgcagggagagcagaaaaatattgagattgcaaatcagagaaagtacaaataaattttgaagaccaacattgagaatacatataaaaaacaggaggaaccattatggatggaatgattaaagtatcaccggaattattaatttcaacagcaggagaattttcaaatcagggaacaacaataaatacactgacaggagaaatgctgcagcttgcaacagggcttgcttctgcatggcagggagacggagcaactgcttatatcacaaaatttaagggattagaaaattcaattcagcttatggttcgcatgattcaggagcatgcaactgatttggaagaaatggcaaaagtatatcaggaaagtgataaagctgcagcggacgaagcaagtggtcttgttactgatgtaattcaataatgaaataatgataaaggctcagaggaaaagaaaaagtgattagaattgaaatagaaacgatgaaaactgctgtctctgagttacaaagaaaaagagccattctctcgaatataaaagagagaatggctaaactggcttatgcagtcagtcagcaatcttacgtggaagaaacggtatgtgagttaagaaaactgaaaaagcggatgggagaaattgaagaaaatctgagagatttacaagaagctcttgaagaaatttgtattttgatagaaaaaacagaagaaaaagtggtttcatattatgaagaagaacaacagaaacctcaatttacaagatttacaattcgatataatcaagagttgctgttaaatccgcatatacaggaacttgcacctatcaggctcaaaaatgaaggggaagcagatgagtaaagtaatagaaattgatacaaatgcattaaattcagataagagcagtatgtcagaagaattgcagcagatacaaaatgaattgaagtcactccaggacgaaatggagacaatgaatagctggtttaccggaccggcagctgcagcgtatcaaagtcatatggaagaagaaattgaaaacgcaatgagtgtatgtacttatcttacagagtatatgaactgcatagaacaggcttcaagagcttatacagagtgtgaacaatcagttgcaggtgtggtaaacagaatcagaatttaaggagagaagcaaatgagcgatgttcaggatattttgattaaagtagagccagagaaactggaagcgttagccggaagagtaaattcaaaaattaaggcaatcaggggacggtttgagcgaattgaatcagaggtaaataactcgaatcattactggaaaggcgagggaggagagactcaccgaagagtttaccaacagtcgaaagaaggaatcgaagaaagtctggaaaattttaaaggaatggtatctgcattggaaacaatggcaggaacttatagaagtacagaaacggaagtgataagttcggcagatggactcccagcagacgtaattatatagggaggatgaaaaatgggattattgaaatttgattttaataaagcgaacgcacaaattcaggaattagaagaaattgcatccgaaatagatcagctggcagctacagactatgagaaccttatgcaacaaatgcgtagtgcatggaaaggaagtgcggcagatgcttatataagaaaggcaagtcaagtgcaggagagaataaaaaatacatcacgggatattaaaaaaacttcggaagtctatgccaatgcagtgaaaagagtacaggcagcagaggaaaaagtcaaagaaatcgcaaaaggaaaaagctgaggttaacagtacatggaaatacttgtattgattatatgtgcagtaataattgtagcggggattgtgttgattatctggattttgagaaatcgttatgataacagcaatgtagtaatacacggtgggatggatacaggaacacaaaaaaacggaacagaatcagggagtttatttattggagtttcaaatgaacttggaacttctgtactaaatggaaaaaacagaagaagaacgtaccgtttttatttaatagatatggaaaaaggcgaaaaatatgatatacaatttcgtgagaatataggaattggaagagcagaaaatgtaagaggaattgaacgttttcttacaattcataatgacatgagaatatcaggatatcattgtaggatttatgcatttaacagtcagatttatattgaagataccggttcaaagaatcatacttatgtgaatcaggagcaggtgacaagacctcatgttttaagaaataatgacgtaataagaataggggatacaaggctgacagtaaaattttagaggtgctgaatatgaagaaaacaatattagcaacaatgatagcagtctttttgatttttgaagggagcgggtgtggaatgataaaaccagtatcgacacaggaaaaaattctttctgtgatgaaagaaaaatatggagaagaatttgaatttgaaggatgggcgcataaacagtatggaagccgtgatatgacagccaatgttacctgtgcttcatttccaggagaaagaatacaggcaggtcaggaagaaaatgaagaaggaaagatgatttactttgatgattacatggcttatcaaaatgaaggagagatgcagacaatacttgagaatttagtacaagaagtatatccgaatgcacgtgtaatctggaaaatcagttcttcggtgtttcccagagaaatgtctccgggaatgagtgtcaaggaaataatggaaagtaaagaatcggtattttctgcttatattgtagtaaatcaggcggtaaatgaagaagaaaaatattatgatttggagaaattaagagaattattagaagaaaacaaaattcgtatgaagggtgcattgttttttgctttagatgaagaagcatataaagcgctggatggagagaattactcttattgggcatcaaaggatggctggtttgagcagaggtgtaattttgcaattgatcaggcatatgaattttattatgcaaattggaggtaagagatgggaaatgcaaatgaaacgtattctgctatttttgacctctttacttattggggttattcaatggaagcggaacctggaaaaacattaggagagatattacaggaagctttagataccgggaattcgagtgaagtttattatcagactttaaatgatgcaattaaacgttatccggagcttgcaaatgcagaatttaagagtcccagctggcagcagggaggacggtatcattcagaaacttacgcttgtgtctttgaattaccaaatggagataattatattgcataccggggtacagatgatggtggatggattgataatggacagggcatgactcaggaatcaactttattgcagagagaagcgtcagattattttgatcagatggcagagcaatatggatggacagaatcggataatatttatgtgacaggacattctaagggtggaaataaagcacagtatgttacattgatgtccaatcatgcaaatctggtggatgaatgtcattcttttgacggacagggattttcagatgaagcaattcagagctttaaagagaagtacggagaagaaggatatcaggaagttctgaaaaaaatgtatgggtacaatggagcaaatgattacgtaaatccgttggggaatactatcattccaaaagaaaatatcaagtatatagatacggttccaaatccaggtagtgggtttgataagtttgcaggcttacatatggaagagcagatgtttcagagggatgaaaatggaaatgcgatagcagttttaggagaagaaacagagcagggagtgatggggaaattctcagctttcttatccgaatttttgatgagtttatcaccggaagaaagagatgctgctgcaatgtttgtgatgcagtttatggaattaagagatgtgggtgaaggtggtggagcattaggagtagatggaacttcgctgacatcgggtgatatctacctgtttattgagagagtattaccgaaactgctagatgcgatgctggaggaagtactggaaaaattcggtcttgataaagaggcggcagagcgtttaattcttttggtaaaattatggatgatttttgcatcaggaaaatgggagtataagttagtcaaagcattgattgacgaattgaaagaacggttattagagttagggcatggatatgagctggcagcgaaagcattagattctcttgaaaaatggattaaagaaaaaatagaattgattaagagctggttccagaagcaaaatgacagctcagactacagtagtttttatgttgaaaccagccagttgttacatttcaaagaagaattagcacagaaaaaaacacagctggaggaaaaagcaaatcaaatccgtgaaattcgaaaaagggttgatttcggaaatataacacagcagtatatttattactgcttggtatcatctgccagaaatcttgaaaatgaggcaaaagcagttaatagattgagtaaaggacttcaaaattgtgtgaaagtttataaacaaaatgagcaaaaggtaataggaatttatggaaaatgtggtggatgatttcacaaaaatcacaacaaaaaatgtcaaaaccctcttctaaatctaacttttttcctttaaaatggcaatcaaatggttgacgttatatggaaaagagggatgctatgacaacttcagaccttgtaaagcagatgtgtcaggaagaggggatgagtattgttgccttagccagagaactggggcagtctcggcagaatttttataagaaactgcaaagggatactttgacacttacggaattaaaggaaatagcgaatgtgcttggagcagatttttcgcgatagctctgtactaccacaaaagtaattatctttcactgacaactgtcctaacacacaggggaagaaaaaagcctaaaagctttctaaaagttggaaaagttgaaaaaatacggtaaaaataggttggaaaaattgaaaaaacatggtaaaaataggttggaaaagttgaaaaaatgcggtaaaaataggttggaaaaattgaaaaataactgtataataaagttgaaaaagatgtaaacttattatacggaggtgcaaaatgttggagcgtttggcaaaaagaaagattcaggaatggcttaaaacaggaaaagatgcatttatgttaactggggcaagacagattggaaagacatatttgattcgtgagtgcttaaaagaaagtggatttccatatgttgaaattaattttatcgaacagccacagcttgtagatgtattctcaaaagcaaaagatgccaaagagttattgatgcgtttaagcttaactgcaaatggaaaattgaaaaaaggaaaaacaattatatttctagatgaagttcaggaatttaaagatatcgttacaagagtaaaatttttggtagaagaaggaagtttccgatatattatgagcggttcattgctgggagtagagttaaatgaccttcgttcagcacctgtgggttatatggaaatatatgatatgtatcctatgggatttaaagagtttgcacttgcagtcgggataaacaaagaaatttttgaaatgctggaagagaaatttaaaaataaggccgttgtagatgaatatgtacattctaaactgttggaagtgttttatttgtatttaattgtaggtggaatgccggaagcagtagatgtgtatcttcgcacgaatgacctggaaaaagtagctcaggttcatgagaaaattatcaggttatataaacaggatttttctaaatatgagattagatataagcttaaattgcgtgaaatatatgatgcaatgcctggacaactggaccagaaaaacaagagatttcaattaaatagtataggaaaaggaatgagttatgaccgggttgaaaatgattttctgtggttgaaagatgctggcgtggtgattcccgtatacaatatagcagaacctaaattaccgctagttattagcgaaaatagaaatcttttcaaattgtttttttcagatgttggtttgttgaccagcagatattccaatcaggtaaaactggcaattctgaatcaggataaatcgattaacaatggcgctctttttgaaaatgtagttgcacaggaattgcttttacatggacataaagaatattatttcaacagtaagaaacagggagaacttgattttgtaattgagctaaatggaaaggtgactccgttggaaataaaatcaggaaaagattataagagacattctgcattaaataacattttgcaaaatcaagattaccagattgatgaagcactgattttttcggaaggaaatgtagaaataaacggaaaacgagtgtatctgccaatttatatgattatatttctggaagaagcgaagctagagaatacggtttataagctagacttaagtggattaaagaatatctaaattgaaatttaaagctgaatatgcaaaaaaaaacaaaacaaaagagctggagggttacgtatccaatgccttaactaaatgacattgaagaaaaaggtactctcgtttcaccgtttaccaaggaggtccaccatgttcattgattcccacatccacctttcccatccatcctactccaccccatttttatattactctccaaccacccattccctttcaaccaccacgcgctcaaacctaatcgaggagtttcgttctgccaaaatctcagcagtcatcgagcctgcgattgagttagaatccaatgaacgacttttagacctcagcagagagtatccagattttgttttcccggcagtaggagtgcatccgacaagaacgccacagacgccttggagtgcgagaaagcaggttgaggagtggtcaaaggataaaaacgtaattgcgattggtgagctggggctggattatcaccatgctagaagagaacagtatcggttaaagcaaaaactgtggtttatctggcagattcttttggcagataaacgtaatcttcctgtcattttacatattcgtcttgcggacagggatgccattcggattttacgattctttaaaaagaaactgcatggcggagtgtgtcattgttttacaggagatgctgaaactgcaaggatttacacacaggaatttggttttctgcttggaattggaggctatcttttacaaggaactgagacgagcagggcattagaagaagcggtgaaagagacacctttggaatttcttgtgctggaaaccgatggaccgtatgtaaaaccaaaagcaccggaggggatttccggaaagcagtggaaaaagagcagaaatacaagtctgatggttccggaagtggcaaagcgtattgccgaaatcaaaggaattgatgtagaggaagtagagcaaatcacgacaaaaaatttcaaaacacacttcaaaatttaacttttttgtcttaaaatggtaaccagatggttgacgttgatagagaaaaataagtgaatgattcgaagggggacattttatgactacatcagaccttgtaaaagaaatgtgtcagaaacagggcatcagtatcgctgcattagcaaaaaacctgggacagacacggcagaatttctataaaaaactgcaaagggacaccttaacacttacggaattaaagcagatagccgaagtgctggatgcaaattttgaacagctttttcgtatgccggacggcacaaagttttctttgaaaagtgagaataaaaaacgaacggtcttaccgcttgttggcagtgcgtttgagccgggaggggcaaaagaggcaattgaaaagttacaggataaggaactttccgagattgcgcaggcggagttgtattatttttcggcacaggcggaaaactgtgtgaagattgtggaaaactatctttccagtgaggatattatgttgagactttcggcagatatgctgtatacctttgcaaatcttacgcttggaaatgcaaaggaagcgcagagttccagagaagacgtctataagtgtttaaaatgggtatttcaggagggtgagacaaacgagaaaaaggcatcctgtgtctttgcgttttatgtcatcagcatttttattcacattccaccggaagaaaatattccgcctttggaaaaatatattccatatctgccaattggtcagcgtctgtttgcgagcagcctgcttgcacatgagacttatcttagaatggagtatgccaaagcgcagggaatcgttcagtctgcgatgttgatgtcggacggaacctatccgatatcgatgatttatttaaattgtgtggctgcgatgtgtcagattaatttaagagagcaggaagaagcgaaaaaatcagtttcttttgcgtgggaaatggcaagaaaagatggatttttagaaccgtttatcgaatatcatggcttgcttcaaggggtattagaggcctgtgtcagaaaaagtgagccggaagtatataaaaaattagtagatggagtgattgcatttagcagaggctggatgaagattcataatccgaagatgcaaaaggcagttacggatttgctcacaccgctggagttctccattgcgatgcttgcctgccgtgactggacaaatcaggaaatcggggagcatctgggattgtcggttaatacggtaaaacattatgtttcgagaattttggaaaaacttcatattgataaacgggataaaataaaagaatttgtaaaccagtaaagagatgtgctctcggaacctttattatacctgcttttacagagtgtctgtttcgtatgatgaaatacgaaacaggcacttttttgatgtcaaacgggcatgtgaaacgaaatccgtttttgataaaattaatgtcaaagatgtaatggttattgagcgaaaaattacctttcaaaagcaaagcaaggaaagaatgcgagagggaataattcaaagaaggggaggggaaatatgaagaaacgtctgattagtatgctgctgagtgcagcattatttgtcacatctataccgatgccggtttctgcggacaatcaagtaaatgaagggaatgcgagtaccgcagtttcaagtgaaggcaatcagggtgaaactcaggaaaatggcattgattataagatgaatggcggtgcttttacatcggggtatgaagcaccggacacttatccggcaggcgaactgccgacagaggaaaatattacaaaggcgggatacgagtttggcggatggtatgaggatgaaaattttagtggggaacgcattacatccttagatacagcagatcattccggagctatcgtactttatgcgaaatggatcgagcgttattattatattgatattccacagacggtatcggcagatggcggtacgctttctatttcagcaaaagcaggtggattttacgacaaagattatgtgagtgtgtcagttgcgtcagaaaatgactggaagctgaaaaacggaaagcatgcattgggttatgaactccgaggggaagagggcggtacaaagctcgaaaacaattcgcttgtaacaagtttaagtgcagaggaaaataagacagaggagaattttaactgtaccgtaacggatacaccgagttatacaggggaatataccgataagctgacgtttgatattgcatttgaagagacacgttataccgttcattatgagacaaacggcggtacgcagtatcaggacaccaaaaatcaagcaggcgaaaatgttgcattaaccgaccagtcctttccggcaggaacggcccttacaaatctgccggagccggtcaaaaaatctgcaacatttatcggttggtgttatgatgcggaatgtaccaagtatgttgacagtaaggacaggctgttaggcgatattacgttatatgcggcttataccgatacccagccgttagatacggtcacgatggaaacttatgcgagagcgtatgatgtggcaacggatttcaccatttcgattaccgatacgagtggaaaattaacggcagaagaacttcgacaggcatgtacgattaagaatgtaagtgacccttcggaagaaattgtattaagtatcatcgaaaacggcgaccagacatttaccgttggaaaggaaaacggatggacggaaggtgcttcttacaaactggaattaaaaaacaatgcgctgtattttaccggctatgacacaagcatccgtgagtatgattttacagtttataaggcagaaattgaaaatgcaaagttaagaagtgaacttaagtacattcatacaaatgatttaagtgatttaaccgtaaatggtcagaaagcaaaatcagtttccgtcgcagttatgacagttggggcagatggttccgtacaggaagagggaagtgaaacttccggaacatttacttataccaaacagaaattaagtgttggagataagattgcagtctattcaggtgatgtgattccgacgatggaactgtcgtccggagaaaacagtgatgtttccttttttgaaattacagcagtaaatggaacgtcttacagctatcgtggcgctgaggcagaagatgtattatttatgccggacgtaattccgcttcttgctgagaaagataaggatggagatctagacaataacagtgcgacagttgctgttagtgatttgacctttggcgatgacgaaatgagtcaggcaatgaatcttaacagtgagacaacaattgactccggtgattttcttgcattttatacggacattaacagcgagacacttttctatggggagattcaaagcgttaccgtttcaggggaggattacatattagactatgtgcctgtttcgtgggaagaaattcagatagcaatggatgtgtatcgaacagagaaagtagatggaaatgaacttttagaagataccgaccgtggcgagtttgaagatgaaatcgaacagcaggcagttgagagtggatttgcaaatgaagtggtagagcggattgccgaagcagcgatgcagacggagtcctttgaagaattagaacaatccttgtccagtgatttgggcgcgggaatttcattgcagccgaatacaaacataaataaaatcatgccgtttgcaggcggaaagcctggtcgtgtgaccgcagagcttgatcacgtaaaggcaaatcttggaacgaccttaaagcattttgatggtgatatcagtggtgtgcgcatggcactcgatatcggtgtgaagattaccatcaaagttgcacagggcgcaaatattgaaattttagtgacagcgacatttgaacaggaagttcgtgtcaacattaatgtaaatggaaaagcagtctggaagagatgggggattttcccgtatattgcagattatcgagtaacggcatcctttgatttatatgaatataccagaatcggtttaaatgtaaactttaaggtcgtagaatccggatttatcgataatggctcgaaacttagaaaaggtgtcaacaagataacagaagaacttaagagcatgatggaaaatggcgaggattatcttgcggataaatcgaaattgtcaggaagtcttggtgattcaggagatgatatttcggtttctaagagccttgccgagcgatattcggaactgttagaagaagattcagactgggtggaaatctataaccgcaagctgctggaacggcatttccgtgtcttattaattatcgatattgaagtacgtttagactttgtagtatctgcaaatgtcaatatttcaatgggtatgagttactggtataaaaatgcaaaacgttatgtgttctgtgtaaaagtaaaagacagaagcgcaaccagtgatacgattgatttatgtgaagaacaatacgaatttaccgcttatgcgatgggaacgcttggacttcgggcaggagtaaggcttacaatcaaagtgggtctgatttctacgaaacttgccagtgtggggatctccgcagaagtcggtggatatgcgcaggtttggggttatctgtattatgaattaaaatatgcggcatcgacgggacggcagaccagggcaatgggtgcgatttatctggaaatcggtatttatcttgaaattaaattccaggcgcaggcacttgccaatgcatttacttacagtccgactttgtatgaaaatgaatggccgctttatcgggttggaagtcttgagagcgtcctggattttgtatatacgcagaatgaagttgaagagattagcatgaagcgtgacattcagtcggtacagctttctgataattacttcaagatgcagtacatgcacatgaaagatggcttaaacgatggaaaatattttgaaaagatttatgatgataattcaaaatactttaacatcgtgatgacaaatccggcatttagttatgaccctgcgacaaacatcatcagcgttgacccgcaaaacaaaccggaacaggatggagaaatgataattacctggaagaaccaggagggcacatttaatacaaaagcgattacaagaaagatttctctgcactgggataaacttcgggatggttattacattgcattccagagtaacggcggttcttatattgaaacaattgtaggaaaatacaatgttccgattcaggcaccgaaaaatccggtacgtttaggttacaatttcgcaggatggtacagcaatgaagaactgaccaaaccgtatacgattccgacaaacatgccggacaatgatgcattggtttatgcaaaatgggaagcagcggatgtggattacacggttgtggactatatggaaaagacaaatggtgtctatgaagcgcagactccggtgaaatataaggcaaagacaggttctaaggtgacaccgactccgacgaaacggacaggatttgagactccgcctgagattaccgagacgatacaggcagatggaagtacggaaatcgagtattattatgcgagagaacagcataaaatcacatttgaatctgagggagaaattctctcacagggaatttataaatacggaagtctcatgccgacaccggcggtatatcgaccgggatatgaatttgatggatgggacagcgaagttccggaaaatgttccggcagaagataagacttatcgggcaaaatggaaaccattagacggtattgcttattctgtaaaatattatatccagaatccggatggagaaggctatgaagtgggtgaaatcaagaccttctccggaaagacagcagaagaagtgactgcaccggaagcagattatgatgaggcagtttaccacttaaaagggcagcttccaaaaggcaaagtaaaagcagatggaagtctggtattaaaagtttactatgatttaaatgaatataaactgacatatgacccggatggcggaacacttgacgagacagaagtaagtgcaaaaccaggcgataagatttcacttccggtaccggttcgggatggatatacctttgaaggctggtatttagacaaagcacatgagcagttatttggcggaacgatgccaagagaggactgcacagtttatgcaaaatgggaaacacagaaagtaaattatacggtaagacatcttcaggaagtggttcataacgaagaagtcgaggcaaacagcgtggaaatcgatccatccattgcggaagaagaaccaatagaagagaataattttgaattagtggaagaagaagtattctctgcaaagacaggtgaaatggtaactccggcagtgaaaagttatacaggatttactgcgccggaaaccgttacagaaaaggttttaggagatggaagtcttgtcattgaatatcgttatcagagaaatatgcatgagattaatctggtatttgatggcaaagaaatcattcgttactggcttcagtatggcgcatcgattgttgagaccccgggaaggatgggatatctgtttggcggatggtacacggatgatacttatcagactgcatttagcggaacgatgccggacaatgatttgagcttatatgcaaaatgggaaccgacagattccgaatacatcgtacgacattacaaacaggatcttcctgcaatcgatgaaaagacttatacgcttgtggaagaagaagtgaaaactgcacttacagacagtgaagtgacaccggaagtaaaaacttatgaaggttttgtttctccatcggcgaagaaagaagtcgtaagtccttatggagataccagcattgaatattattatgatcgagtttccagtccggttacttatgtacagaataatggagaagcagacaaggttgaagatactttatttggtgaagaaatttcctatattccaaaacaatccggttatgcatttgtcggctggtatttagatgaagcattgactaaaccgcttgagaaggcagaaatgccggcacacagtctgaaactttatgcaaaatgggagcttggaaagaaatcctatcgtgtcaaccattacattcaggaagtgcgacttggtgaaaattatgaactggctgagagtgaaaactttatcggcacagcaggtgaaatggtagcaccggaagttaagacttatgagggattcacctcaccggaaaaacagtattatgaacttcaggtatcggatgacatggaagtgttcaattattactatcagcgtaacagttacaatgtgacaatagacagaaacaacggcagtgagaatattacattagaaccggcgtatgaatcaaaaatcgaataccgtccggaaaagatgggttatcagtttgcaggctggtatctcgacaaagagttaaaacaggaatttggtggaacagttccggcgaaagatttgactctgtatgcaaaatgggaggcacaggatgtttcctacagcgtgcgccattatctgcaaaatgcaaatgatgacggatatacctcagcaggtacagagagctttacagcaaagactgacagcagtgtgacaccggaagttaagacttatgcaggatttacctcaccagagacacagacagcaaccgtaacggcagatggaacattaaatattacttaccgttatctgagaaacacccataccttgacagagaaattctgcgatggcagggaagataagattcagacgatgcggtatggttcagcgattgcgggtgtatcaaaagcgggttacacctttgcaggctggtatttggatgagaactatgaaactgcatttaccggaacaatgccggatcaagacctgaccttatatgcaaaatgggaagcaaagaaaatcaattacgtggtggaacactatcaggaaaaggcagatggaaatggttatgttttaaaagaacgtgaaatcaaaactgccgataccgacagcactgtgacaccggaagtaacctcttacacaggatttacctcaccacaggtacagacaaagaaagtagacggcgcagagatgacagtgattcagtatcactatacaagaaatgttcaccgtctgacctttgttcttgaaaatggagaagcagataaggtttctgatgttcgttatcagagtacagtgactgcaccaaatccaaaacgggaaggttatacctttgtcggatgggataaagaagtcgttgagacgatgccggacaatgacgaaacttatacggcagtctggatgaaaaatacttacacaatccgctttaacacagaaggcggaaatgaaatcaaagaaatgactctggaatatggcgaaaagattaccaaaccgaaagatccaacacggaaaggttataactttgttagctggaacattgaaattccatcggaaatgccggcaaaaaatctgatgtgcaccgcagtatggaagaaagaaacttataccatcagctataacttaaatggcggaagtgcttctaatccggcaagttacgatgtggaaagcagaccaattcgtctggaaactccgaaacggacaggctatacatttaccggatggagcggaactggactttccaagaaagaaatgaccgtgacgattccaaaaggttcaaccggaaaccgcagttacaccgcaaactggcaggaaaatacttacaccatctgctttaccacctgtggagtcggcacaactggttcaatggaccagataaaaatgaactatactcagacaaaacaattgccggataacaaatttgtttgtaagggctacaccttcatcggatggtcttataaagcaaatcagaccattgcatattatagagaccacgcatgggtaagcaaactttcggatgcaaataatggtgttgcaaccttgtatccggtatggaaagcgaacacgtataaagtaacctttgattacggatatgataacaagaagtcagaagttaactgtgtatacaacaaaaattattcgcttccacagaatgtaacaagatacggctggtcctttgaaggttggaaactgaaaaatgcgacagcagtaacctataaaccaggcaagaaaaatgcaaaacttgaagatgcagaaaatattgtgttgcatgcaagctggaaagcaaataattcgtacagttatcgtccatcaagttcgtcaaacagatatctggttacggatgaccatgaactgactaaatttacattctatgtggatggaaatcagacttctgtaaagacaaccggcgatacgggacaaaatccggcaagatatcatctgaatatgacgaatctttcttatcaggcagttcataatagctacagcaagatgaagataaagataagctttaagattacgatggaaaaagatggatatgcagatttaagagtttcttatcattccagaacacaaaataagacttatgaaaaatggaaaaccgaagtagaagacatcaaggcgaagaacggagagaccgtaacgtatacttatacaaaagacggcaccgatgcagataatatcacattggaatttgacgcacatggaaaaaattctgataaatattatctcagcaacttaaatgtagacgttacttatgagtagtgagcaagggggaagtgcagatgaacggcaaaaataaaacaaataaaatactaatcggaattattatctgcctgattgcagtgattattggaggggcaatttattttacaagaggtacagacaaagacaaggaaaataaaactctggattcggctttcgagccgaatctggactccaacgcaagcgagactgcctcaaatgacgggaacaatgaagaagctgataaaccggaaggaatccggattccgggatatccatcaattacagttccggcagatacaacagacatagaaatgaatctggaaaatccggccggaaatccatgctactttacatttgaactggtgttaaaagatacaaatgaaactctgtatacctcgaaaatggtagaaccggggaaagcaattacgaacgtaacactgtcgcatggacttgaaaaaggggaatatccggctgtgataaagatttcgacagcatcacttgaggatggctctgcaatgaacggagcaaatgtagaaactaccttgattgtacagtagtaataatatgcgctcggagtcttcaatgcacttacttttatggctgattttttgccagctgtacccgaattttatcaaaaaattaggcacaaaaagattccgaacgcacataagaaaggaaagacaggaggaacactatgagaagaaaatggttttttgccggaatcttttttacagtgatgcttgccaatactgtctatgcaaataatacgacaacggtaagttatacagtaaatccggcatatacagtgctgattccggtggatacagaagttgaatttaatcagttatcagaatcatttggaaagattcaagtagaaaaagcacagcttgatgagggaaaatgcattgaggtttctttaagttctgacggagtattgaaaaacaaaaataatcggagtgatgtgattccttatcagattttaaagacgagtgaagcgacaccatttgtgtcagcgaggtatcacacggcaggagaagcgacaccgcttaccatcagtattaaacaagatgactggaacaaagcaccgtcgggagattactcagataccgtgacatttacgatttcctacgtggatgataaataaatgagaggggaagtattatgaagaaaaaaacaattatggcagttttaataggaatgacagtcataatgacacaacagaggattatcgttttagcagcaaccacttcaggtgatcggcaaagcagtaccgttagtgcaactgtaccggataaacatacgattacaatcgataaagatgcgcatgttacgattacttatgaggactcaaaagatgaaggggagggagatgcatttccgatagaacgcttttcaactccaacctttacgattgaaaccgaagacggatgggagattgataaaatccttttaaatggcgtagatatcaccagtcagctgagcaataaaaagctgacgctgccatccgtttatcaaaatgagacgctgaaaatttcaacgaaaatcaaaccggcatataccgtagtgattccacaggataccaatgttcagttcaataaattgacagaaaactttggaaaaatttcaatggaaaaagtatggttggaagatggaaaatgtattgaagtatcgatgagttccgcaggaaatctgacgaaccagaaagattcaagtaaattaattccatatcagattttggaagaaggaaaagatactccgtttacatcagcaaaatatacggcgcagggagaagaaacttctctgcttatcgacattaaacaagatgactggaataaagcggcatccggttcttactctgatactgttacgtttacaatctcttatgcagacagtgaatgatggacgtgtctgatttgtcatctactgcgttagcgtcaatcaccgtagctccgctacgtttcattccgctgccttgtatatgaaaaaatcattcaacgtcaaatatcaatgtagtagagatttgctatacattatacttgtgaattggaggaggataatgtgaagaaaaaaatcgctgtgctggctggaatctgtatgcttgtcagtgtgcagggaacggtttttgcagccgataggaattcgcccgatgatttgtcagaccagacggttcaaagcgtaattcgtgcagacgtgcccgattcccataagattactgtaaaaggagagcatgttacggtcagtcttgagggaggaaaccaagaagaaaaccaagaagaaaacagtattcttgtagaacggttttcagaaccaaagttgaaattcagccctgaaaaaggatggaaaataaaaaaggttctgctcggagatacggatgtcacaagtcaggtaaaagatggaataatcactttggcatctgtgtatgaagatttgatattaaccgtcgagactgaaaaaatcaaagacgaatccggcgcaaaaacagattccaaatcaaacacaagcttcggtcagaaaacaaatcaaaacaataaaaataatcagacaagcacaacaaatggaacaaaaacaactgcaaattcaggcagtgcaacaactgtgggacagggaatcaaagcagccgtgacagaagatgaaatgaatgtgggaatttatggaatcggagcggttgcagcaggaggaatagcagtgcggtgcttgaaaagaaaaaagaaaaaaatctgatttttggtatattgcaaaatggaaatggaatatgccataatgccaataggcaaagagatacaagtcatccataggtgacaaaaaacgaaagagccagaggtggggtagacctctggctctttctattccaatttttgcagcaatttatctcttttctcaactaacaaattaaactattgcttgtgatacacaaatataaatggtactataaaagagaaaagactcctaaaaaaattaagaaaggggcaagtttatgggaagagaaggagaagttaaagtaaagagtctgcaaaaagcaatggaagtattagagtgctttatacaaaagcagccgcttggagtaacagaaatcagtgaaaaactggggctgtataagagtaatgtgcataatattctgatgacttttaccgcacttggatacttaacacaggatgatgaaaccggaaagtttcatctgggagtatccgtaatgactctgagccgggcatttcgtgaaggacttgatattacaagagtcgcagtaccatttatgcgagaaattgcaaatgaggcaggagagctgatctatctgacaattccaaaagatgacagtgtaatctatctggaaggaatttcaccggatcatcaaagaatggtcagtaaatcggttgcaggagaagactgtaagatgtattgcactgctgtaggaaaagcgatgcttgcaagtatgccgaaagaagaagtcgaaaaatgtatttcagggaagcttgaagcgtatacagaaaatacgattacagataaaaaaagtctcttagaagaaattgaaaaaacacgaattcgaggttatggaatcgatgatatggaaatcatgtttggcattaaatgtgtgggagttgcactgttaaatcatgatggaaaagtggaaggtggactgagtatcagcgccccatcgcttagaatgagtgacgagaaaattgaattatatgcaaatatacttaaggaatatgccgcaaagatacaaaaaatgttataaacttgtgcaagtttactgaaaaataaaaaagcagaagaaaaatattgaaaaaaaacacaaaagatggtaaagtagaattatcaaataaagaacgtagttctctaataaagaacagatgaaagaggaacccgacaggaagtcgggtaaaaaaatgaacgaaaataagaacactgttctgtaatagagaacaaaggaaagatttagggaggataaaaaatggcaaacaaaccgtatgtagtagtggaatggaatgacacagagacagatgcaaaaggatggatgtgtgcgtacaacttcgttggacattattgtggcggtggaacaagaatgcatccgacagtaacaaaagaagaagtaattcgtctggcaacaacaatgggatacaaatataaagcatgtgaatcccagacaacaggtggatgtaaagcaggtattgcttatgattacaaagctccagatgcactcgatgtattaaagagattcttaaccgcaactgctccttatattaacgcaggtgtttccatcggtggagacttaggtgttgattattcagacgtacttcgtatcttagatgaactgggaatcggaattcctcagacaaaagcaatgaaagaagacccagatatccatcagggaattgtaaaccatgacagagcagaaaaagaattaacctatgacggatttaaaatgtatgacatgattaccggatatggtgttgcagctgcagccgatgaagcctggaaattaaaaggcggaaaagaaggcgcaagcgtagtaattcagggattcggatgcgttggtgcaagttgtgttaactccttatataacatgggttataaagtagttggtatcgcagatgtaaacggactggtttactgcaaagacggattgaatattccaaaattagttgaaacaagacttccaaaaggtgaattaaaccgtgaagcgtttgaagataattatgaagttcttccaaataccgaatggatttcagcagactgtgatatcttaattccggcagcacttgaagatgttatcaataaagataatgcagataaaatcaaagcttctcttcttgttgaagcagcaaatattcctaccactccggaagcagatgaaatccttcagaagaaaggcgtagatgtagcagttgactttatttccaaccttggtggaattcgtatttatgaagctgttattttccgtattgtaaaaattgaaaatatgaatgatgaagaagcagcaaaagcaattgtagatgatacagtaaatctgattcgtaaacagactaaacttgtatttgaagaagcagcaaaaaccggagaatttacaagagacgttgcaagaagattatttacaccggataaatctgacacaccggatatgtaagaaaaaacttacagaaatacaacgtgaaagaagttgggggctgtcggaaagacagccccctttttcagtttatgggatgagaaacattctaaattaggaaaaaagaggagggtgtttatggagtcaaaagcgagaaaatatttgaccattattgcattagggcttgcaggaggttcaatttatttcattccttatgtaaaatatgtattttacgatgcacagcttgcggcaatgggaattaataatacacagtcaggtttattgctgaccatgtatacgattggaaatatggttctttatattccgggcggatatctggcggataaggtatcaacgaaaaaagctttgattatatcgctggtagcgacatccgttttaacgtgggtttatgcattttcattaaattttgtcgtttctatgattatatggcttggtctttcctttagtacagcctttgtattctggtcagcacttatgaaagcggtacgaattgtaggaacagaagaagaacagggattcatgtatggtttatattacgcttgtaatggaatcgcagcagctttaacaagttttatttctctgtatgcttataatacagcaggcgaagacattaagagcggatttgtacgtggtgtaaatgccagcggagttgttgttcttatcgcagccatctgtttagtattcttaatgaaagaagatgcaggaaaagttacaacagaaagtgacgatgataaaatttctcttccaatggttggaaaagttttaaaatcccctgttgtgtggattttatcaatcgtaatcttatgtggatatggattaaaatccagtgtttcttatttcaatccatatttaacagaagtagttggtgtttcagcggttaattcaggtattttctcaattattaataattatctgttgttattacttgcaccggttggtggaattttagcagataaggtatttaaatcaacatgtaaatggttgagtgtgtcatttgtgattcttgcagtattattcggtggagttttattgattccatctgacatcagcccgatggtagcaagtatttatactttacttccaggggcagttacaatgatgatgtatggggttgtattttcatcagtcagtgaagcaggtatttcaaggacaatgacgggaacggttattggaatttcatccattattggttatattccagattccatttattccgtaatatttggtaagtggttggataataaaggtgcagcagggtatacaaatatctttattttcctggttgcatccggaatcgtaggagcagttctcgcattttggatttatcgtcatggtaaacgtgcacagcatgatgcgtgatgcattagtaaaaatatatgaaggagaagcaagttatgggtaaagagaaaacagaaaaggtgtatacaaacccggtaagatgcaaaggctgcggatattgtattaatgcctgtccgcaggaagcaatcagtgtttccgatcatgtaaatgcaaaaggttataacacgattgtagtagatgaagaaaagtgcgtggtatgtggtatgtgttatcgtgtatgcccggattatgtatttgagattagataaggaggtcagtcacttatggcgaaggtattattaaaaggaaatgaagcgctggccgaagccgcattagcagcgggctgtcgtttttatagtggatatccgattactcctcagacagagattctggagtatttatcatggagaatggaagatgtaggtggagtatttattcaggcagaatctgagttagccggaattaacatggtgcttggagcagcggctgcaggtgcaagagcacttacaacttcatccggtcctggattttctttaaaacaggaaggaatttcttatttggtagcagcagatttgccggcagttattgttgatgttatgcgaatcggaagtggtcttggagatattgcacagggtcagggagactactggcagcttacaagaggtggtggtcacggagattaccatacactcgtacttgctccggcttccgtacaggaaaatgcaaacatgatggcagaggcatttgaccttgcagaaaaatatcgtcatccggtgttgattgcatctgatgcagcgattggacagatgattgaagcagttgaaattccggaatttgttgagcatgatatcaataaatttgactggaccatcaaaggatgtaaaaaaggctgtgaacagcgtaaaattcagaacgtttattatacacatcctgattatgaaggctatttatcctctaaatatgcacagatggaagaggaagaacagcgctatgaaaatattcaggtagaagatgcggaagtggttctggttgcttatggaatcagttcccgtgtaagcagggaagcagttgaaatcgcaagagcacagggcttcaaacttggtttgattcgtccgattactttatggccattcccgaaaaaagcatttgaagaagcaaaagaagcaaaagcattcttaactgttgaaatgaatattttaggacagatggtagatgacgtaaaacttgcaacagaaggcaaatatccggtagatcattatggttctatctttgaaattcctgaaacagatggaattattgcaaaagcaaaagaaatgttaaaaaagggggagatataatatgagattagtagctcctgaaacgattacatttacccagagtggtttttgtccgggatgtggacatggtttagcagtacgtttgattgctgaagttatggaagaaatgggcttaagcgaacagcttttagcagttgtagacgttgcctgtggttcattaaatattgactcctggagattcgatacaattatggcagcgcatggaagaccaatcgcaacagcaattggtgtaaaaaaagttcgtccggaaaatccggttatggcatacatcggtgacggtgcagcttactcaatcggtatggcggaaaccatgcatgcagcacttagaaatgataatgtagtgacaattgttattaacaacagtttatatggaatgacaggtggacagtgtgcaccgacttctcttccgggacagattacaacttctacaccaagaggaaaagatccgaaaaaagcaggtatgccattccgcgtagaagaagcatttaccggttttgatattgcatatctggcaagaggttctatggcagatgcaaaaggcatgatgcagtcgaaaaaatatgtgaaaaaagcatttgagaaacacatgaagggagaaggattctgccttgtagaattattatctccatgtccaaccaatctgaatatgactcctgttaagagtgtggaacgtattaaaaacgaaatgatgcagtacttcccactgggagaatttaaagataagaaagaggaggaatagacattatggcaaaagaaattatttgtgccggatttggcggacagggcgtactgacagccggaatgcttttgatcaacgccggtatggaacaggataaaaatgtattgttctatccttcttatggttctgaaatgagaggtggaactgcaaactgtacagtaaaaatcagtgataaattaattgcaagtccaatttccaaacaaccggatattttatttacgatgaatacaccggcaattgacaaatttgaagaaagattaaaaccgggcggactgcttctggtcaactcatccatcgttccggatgacagaaaatatcgtgatgatattaccgtagtaaaagttccggctactgacattgcagtagaagtaaaaaatccaaaaggtgcaaacctggttatgctcggtgcacttgctgcccacagtgacttattctctattgaatatatggaaagcgcaattgtttctttctttgagaaaaaaggaaaaggtaaatttaacgagaaaaatgttgcctgctaccgtcgaggtgtagaaggaaaataaaaactggaggtaacgggaaatgaatttaaataaactgttgaaaccaacatccgtagccgttatcggtgcaagtgaaaaagaaggatttggtggagatgtttgtagaaatattttaagttacgtggaagatagaagccatgtgtattttatccatccaaaaagagacagtgtttttggagttccatgttataaatccatcagcgatgtacctgaaaatgtggatttaatggtaatctgtacttcacagaaaacagtaattccgcttttacaggaaggcgcaaaaaaaggcgttggcggagcagttgtatttgccagtggttatggtgaagttggaacagcagaaggaaaacaaaatgaagcagaactgattgcagcagcaaaagaactcaatattgcggttatggggccaaactgcgcaggttttgtgaattatattgataatgtacaggcattcgcatttatctctgcaaaaagagacagaaaaggaagcgttggtgtcgtgtcccagagtggtcagctttgtctttccatgatggatgacccgggaatgcgtttctcttataatatttcagcaggaaatggaaaaatcgttcaaatggaagattatatggacttccttgtggacgatgaagatacaaaagtagtcagcatctatattgaaggtgttaaaaatgcagataaatttgcagctgtattgaaaaaagcagctgaaaagagaaaaccggttgttatcttaaaagcaggacgaagtgcaaaaggtggagcaatcgctgcttctcatacaggaagtctttccggctccgatgcatcctttgatgcagtattgaaaaaattcggagcaatccgtgtagatgacctggaagaattaattgcaatgtcactcatgctttctactatgaagagaatgccggaaaaagcaacatttgcttctatgaacttatccggtggagagacaggaatttgtgccgatgtaggaagcttaaatggaatcgaatatccggatttcaccgaagaaactctgaagaaattaaaagaacagcttccatcttatgcttctccaaacaacccgctcgatatgactgcaagtctttcttatgatgcagacctctatgcaggagcacttcggacggttatggatgacccgaatatcggtatggtactgattggatatactctgcttcttgaaattgcagacccgtgtatccattacatgtataaaggaattgaaaaggtagttcaggaaaaaggcggtaactgcaaaccgattgccatgataccatttgcggagaacacaagaaatcctgaatatcaggaaaaattattccagataggcgtaccggttttaccgcctccggtatacgccttcaaattactccgccatctggctgactttatcgcttatgaaccggagacaaagactctggaacttgcggtaggacatccgaagagcgaagaaacacaggcattatctgagcatgaaagtaaacaggaattaaaagtatacggtgtaccggtaccagatgaagtcatcgtaacatcgaaagaagaagcagctcagtttgcaaaaaatcatccgggtccattagtaatgaaagtagaatcagctgatatcctccataagagtgatgtgggcggtgtaaaattaaatgtttgtggtccggaaacagcagaaaaagcttatgaagaaatcatggaaagtgtaaccgcaaagagaccggatgcacacatcaatggaattctgacagttccaatgttagatgccggtgtggaaatcatcataggcgtaaacaatgacccgcagtttggaccgatgatcatggttggaatgggcggcgtctttgtagaagtctttaaagatgtagccttatatccggcacctctgaaagaagaggaagcgcttgaaatgttgaaatcactgaaatcatttaaacttcttaatggatatcgtggaactgagaaatgtgacataaaagcattgtgtcagacaatcgtagcaatcagcaattatgcccaggccaataaagatgttttaaaagagctggatatcaatccattgtttgtatatccggaaggtaagggtgtcggtgtagcagatgctctgatcgtaaagagaaaataatgtattagctagtccatttggtaaaaaataaattcagagatatcccgtagaagtcaaagatgacagactacgggatatttctgtttttaagagaatgtgctctgagagtacataaggaaatttagggggatatatgattcgagaaataaaaaaagaggaaattgcggagctcattcagaaagtagatgaattaggtaggtatttgacaaatcatccggaagtaagtggagaagaaaaagagtcatgtgaatacattacgcagttcctgaaaaaagagggatatgaaatcactgcgccttacggagaaatgccatattcttttcgggcagtggataaagaaaaaaaacagtttcatggaaaaaaagcggtttttttatgtgaatatgatgcgttgccggaagtggggcatgcttgtgggcattcttacagctgcgcaatcagtattttaggagcattattgttaaaaaaattttatccggatcttccgatgcgaattgatttagttggcacgccgggagaagagtttgttggtggaaaatgttatatgactgaaaatggagcatttgatgaatatgaatatgcagcaatgattcatttatataacagagattctacatattttgaaattcttgcatcaaatgatagatactttacgtttcatggaaaagcagcgcatgcatctgcgttcccggaagagggggttaatgctttgaatgcggcgcgtttatatatggaagcaatggacatgtggagacagcatattacaaaggattgtcagtttcatggcattgtagtaaaaggcggagaagctccgaatattgtaccggaggaagtttgcctggattattattatcgagctgcaacgctggaaaatttatggaagttaaataagatctcagaaaactgtgcgagaggtgcggcactggcaaccggtacagaagtggagtggcagcagagatatccggattatggagaaatttattggaatgaatatatggatcagattatgaaagatatttttgaacatgtaggaagaacttgtgaagattctccgggacctggaggctcttcggatattggaaatgtaaatttgaaaattcctgtgtttcatcctttactggatattacgggaaaagataaaacgtgtgttgtgcatgatcgtcgttttgaacgaattcttcatacaacagaaatgcaaaaagcactgtatgatggtgggaaaatcctgtatgaattgggatatttgctggctacaaatgaagaaaagttaaaaatcataaaagaaatgcacaaaaaatatagaaaattagtctgaaaaaggttaaaatatataaatgtatgcagcgggggacattggaataggcttgaatacgaaagggggcagtttatgcgaaaactatttgaaaacatagaaaagaaaatatttataccggcgtttttggtattaattgtactgacacttacgatttatctgtttccaggtcaggtaaacggagtgatttcgattttattttcactttgtacccatgagcttggctggttgtttatgctgacctgtctggcatcatttggatttatgatttggctgacattcagcaagtatggaaagatcaaacttggaaacaaagatgaaaaaccacagtacaataatttgtcatggattgcgatgttgtttacagcgggggttggaacaagtattgtaattcttggatttttagagccgatttattatgtgagtgcaccaccatttgatttggaaccgtttagtaatgctgcatatgagtatgcacacatgtatgggcagtttcattggggcttcagtgcatgggcattttataatccggcgattgtggcaattgcctatgtgatgtatgtgcggaaagaaaacagtatccgcttgagcaacgcctgtcgaagcgtgcttcataaaaaatcagatggatggcttggacacattgtggatattcttgttgtattcggtattgtaggttcgatttctacatctcttggaatcggtgcaccggtgctttctgatattatccgtgaagtgtttggtatccctgcacagtatgattttactgtaaaaattattgtgttgattatctgggtattaatctttggaacaagtgtgtatctggggttggataaagggatccagcggttaagcaatattaatgttgtgctggcatttatttttatgggactgattcttttgattggaccgacaatgcagatttttaagatggaagtaaactcaatcggtttatatgcatctgattttatcaagatgagcacttatacagatccatttggagaaggaaaattctccagtgagtggacggtattttactggggatggtggattgcttttatgccgatgatgggaatgtttgtcggtaagatttcaaggggaagaactatcaaaaatgtaatgtggggacagcttctatgggggacactcggatgctgctgcagttttatgatttttggtggatattctctttacctacagcagtccggaaaagttgatttggcgaccatccttgcagaagaaggaaatagcggtgcaattattgcaattttgcagacccttccaatgtctaagattatgatgctgttcttgtgtattgtctgttttgtctatctggcaacaacgattgattcgtgtgcttatgtactggcgggaacaacgacaaaacgcttatcctataaagaagaccctgcaagatggaatcgtatcttatgggcagttttattttgtgtcttatccattgggcttatgattattggtggattggaagctgtaaaaacgatttcggtgttgacgggactgccactgattgcagtgttgattgtgctgatggtttcagtgaaacgaatgttgaaagaagacgaagaaaaggaagaaaaaaggaaatagaaaaattttaactaattaacattcaagaatagccgcttagtttaggagacgtgggcggctatttttgtgatttatgattatctttacctatttacttataacagtcagtttcaatttttctaaaaataatcactgttgaaactctcaggatatgattcaataaacttaacaataaaaataaagctgagaaaggggtttataaatgataaaggttataaaaaatcatggaaaaacagtgcatgcatatcgcctgggagaagacagtgaaaaaattcagcaattaataaaagagaaaaaaatcattccgcttccgaatgataaattcgaagtgaaatcctcagaaacgctttcaagtcaaagtgagcatggtgaaattgcaaaggcaggagatttcattaaagtggacagtgatggtaatccctatccaaatggtgcagaatggttttatcgaaatcacagacatttggcaggagatgaatatgaacagcttccgcagactttagacgcctggacgtgcaatgagaaaatgtgcagggagattgagtttttaattcaacataaaggacttgtaataaacgaacaagaggaggcagattattttgtagcgccactttggggaacaacagagactgccgcaaaggatgctgtaattgtattttacggaattacatatacagagaacggtgaaattatggatgtggagtttaattttgtcaaacgcacagaatttgataaaacctaccatatcacggaataaaaaatctaaaaaaataatgcgtttttactgcgagttttagctatatggctagtgtacaaaatttgataaactgatataataaaattacgaatatatacgtaaaaaaataaatttgtgcgaaatcagcagaaaggaaggtattattatgggtcttattaaagcgggagttggagcgataaatggagtattggcggatcaatggaaagagtttttctattgcgaagcgctggataagaatattctggtaactaagggacagaaacgcattggcaaacgttcctctaatacaaagggcagtgataatattatatcgaatggaagcggaattgcagttgcagacggtcagtgtatgattattgtcgagcagggaaaaattgttgaagtctgcgcagaacctggagaatttacttacgatcgttcgactgaaccaagtatttttacaggaaaactgggtgatgggattaaagagacgtttaagacaatcggcaaacgatttacatttggcggagataccggaaaagaccagagggtttattattttaatactaaagaaatcatagataacaaatttggaacaccgaatccattcatgtttgatgtggtaaataaagacatcaatatgagaagaactgttcaggtgcgctgtaatggtgtgtattcttataagataattgacccattgttattctatacacaggtttgtggaaatgtagagcgtgagtataccagagaagagattgaccatcagttaaagacggaatttatcgatgccctgcagccggcatttgcggcactttccgaattggaacttcgtccggcacagattccggcacatacaaaagaattaaaagatgccatgaatcgtgcattaaagatagaatggacagaacgaagaggaattgaagtacaggcgattgccttaaatccaattacactcactgaagaggatatgaagaaaatcaaccagatggaggatgcagcaacactgggcagtaatccatttatgatggcaggacgtatgacagatgcaactgcaaatgcaatggaaaatgcagcttctaatccaaatggggcaatgaatggatttgtcgggatgggcatgtcgatgaatgcaggtggagcaggtgcaggctttggcgcagcgcagagcttttataatcagggagttcagcaacaacaggcacagcagcagatgcagcaaatgcagcagaccgagcagcagacagcacagaatcaatccgggcagcagtctcaggatagttggaaatgtgcatgcggagcagttgtaaccggaaaattctgtaccgaatgtggagcaaagaaaccggaaccaattcaggcaggaagatggaaatgcaaatgtggagcgatggcaaccggaaagttctgcccggaatgtggctcacctaaaccattagaggatggatggacctgcacctgtggaacagtaaatcagggaaaattctgccagaactgtggagcaaagaaaccatcgggtgcaccgttatatcgctgtgataaatgcggatggcagccggaagacccgaagaatccacctaaattttgtccggaatgtggagacccttttgatgagaatgatgttcagtaaaaaatatattttaggctcttttgatatttaatttgtgaaaatatttttgatgattgtgtcagaatttctaaagtataagtaaatgaaagttattacatcataagaaaagagagggggaaactgcatgggaaatttacaggaatataagtgtccgtgttgtggaggcgcaattgagtttaacagcaaacttcaaaaaatgaaatgtccatactgcgatactgaatttgaaatagaaaccttacagggctatgaaaaagaacttcaaaatgaacagtctgacgatatgacatgggaaacttctgccggaagtgaatggcaggagggtgaagcagaagggcttagagtctacacctgcaaatcctgtggcggagaaattgttgccgatgcaaatactgctgcaacatcctgcccatactgtaataatccgattgtgatgaccggacagtttgagggaagcttaaggccggattatgtgattccgtttaaattagataaaaaagcagcaaaagaaggtttgatgaaacatttaagcggaaaacggcttctgcctaagattttcaaggaccagaatcacattgatgaaattaagggagtgtacgttccattttggttgtttgatacagatgcagaggcacatatccgatatcgtgcaacgaaagtgagaagctggagtgatagcgagtacgattataccgaaacaaaacattatatgattcacaggggcggaaccgttgggtttgaacgaattccggtagatggttcctctaagatgccggatgatttgatggaatcgatagaaccgtttgattttaaagaggcggtaaaattccagatgccgtatctggccggatatttggcagataaatatgatgtaagtgaggaagaaagtgttgggagagcaaataagagagtgaaaaaatcgacagaaaaagcatttgcgtctactgtcaaaggttattcttctgtgacaacggaaaacagcagtatacagttgcaaaatggaaaagcaaagtatgcgctgtatccggtttggattttaaatacgacctggaagggagaaaaatatctttttgcgatgaatggacagactggaaaatttgttggaaaccttccggtggataaagcggcagcaggaagatggaccgcattgcttacagtgatatttggagctttgagttatggcattatctggctgttttggttgtttggtgtgttatagagggagggcggaaaaatgaagaaacgaatttttacagtttttttaaccatacttctttttatgctttccacagtgggagtctgggcgtcagagggatcagatgacagcggattttcaggggagtatgaacgtctgactgatgcagcaggattattaagcgaggaagaagcacagaatattttgacaaagctggatgaagtaagtgagcgtcagaagtttgatattgtaattctgacagtagatagtcttgaaggcgcaacagcgacggagtacgcagatgatttctttgattattatggctatggatatggcgaagggaaagatggaattttattcttagtcagtatggaagacagagactgggcactttcaacacatggatacggaattactgcatttacagatgcaggatgcgattacatagcagaacagtttaagagttcactttcagatggtgaatatgagaaagcatttgaaatttatatcgaccagtgcgatgcatttgttacacaggcgagagaagaccgcccttacgacaattccaatcttccaaaaaaaccacttggaatgatatggattccagttgcactggtgcttggatttatctgtgcattttcaattgtaggaggaatgaaacgacaattgaaaaccgtggcaagaaaaacaacggccggaaattatcagaaaaaaggcagtctaaaagtgacagaaagcagggatttattcttatatgaagatgtaactcgtacagcaaaaccaaaatccagtgatggggattccggaagcagtacccacacttcatcgtcgggggaaacacacggcggaagcagtggaaaattctagcaaattgggctgaaagttagtctttcaaaggggagtatataagggtataatgaaagaaaaattaagactgattttgttagagaagggaaattatgacatgaagattgcaattttaggtgctggaagaatcgcagtacatatggcagaaacactggctggaatggatgatgttgaggcttatgcagttggagcaagagaacttgagcgggcagaggcttttgcagagaaatatggatttacaaaggcttatggttcttatgaagaaatgctggcggataaagaaattgatttagtctatattgctacgccacattcccatcattataaacacgcaaaaatgtgtctggaagcaggaaaaaatgtgctgtgtgaaaaatcatttaccgtaaatgcaaaccaggcaagagcactttttaaactggcggaggaaaaaaatctgttaatcacagaggcaatctggaccagatacatgccgtcaagaaaaataattcaggatattgtggaaagtggagtgattggagaggtaacttctcttactgcaaatttaagctatgcagttacagaaaaagaaagaatccgtaaaccggaacttgcaggaggtgcactgcttgatgtcggagtctatccgattaactttgcaagcatggtgcttggtgaaaacctcaaagatgtgcagtcgagtgcaatttttgaaggcggcgtcgatattctcgaaaccattattatgaattttgaaggaaataaaatggcaacgcttcagagtggtgtcagagaaatttctgatagaatgggaagtatttttggaacaaaaggctacattcaggttcaaaatatcaataatccggagaagattacagtatttaaccagaaccatgaagaaacagcaagctattttcctccaaagcagattacaggatacgaatatgaagtccgagcttgtaaaaaagcattggaagagggcaaaattgagtgtccggaaatgcctcatgctgaaacggtaagaatcatggagattatggatggtttgagaaaaagctggggatacgaaattccggaagtgtactagacttaaataagtatgttataaagtgataaaacaaatgtccatacagacagcaaagcaaaatccccgatgttgccgcatcggggatttttacgctctagtagaaaatgtcaagaaagatttaaaaattttgattctgtcagtcgccttttaagactacacgaattctcttatagattaaaaatacaatcaaagaagtcagtgtgtatttaaataagttaaatgggaaaataatcaaggctgcaaatgtcagaagattatgaacagaaccatgaacggcacttcccatctgaataaatgcatcaaccggcattccgaatgcttttccgtaagccggaagcagaataaatgcattgataaagcaggctacaacagaggttaaaagtgttccggcaatcattccgagaacagcatgttttctatttttcatagaacgataaatgaaaccggccggaacaacgaaagcacatccaaagataaagttggcaacatcaccgacaccggctgtcattgtaccctttgttaccagatgaactaagattttcacaagttccacccagacacctgcaagcggtcccattgcaaaagaaccaactaataccggaacttcagaaaaatccagctgataaaaacttggtgctaaaaaaggaatcggaaattccagattcatcaaaattcctgcgattgcaccaagcatcgcaatctgtgtaattgttcttgtacgacttcttgtcgatacatttcttcttaatacctgttcactcatttttcgtttctcctttaaaacttatgattttattaagagaattctttgaaaatttcttagtctatagcatatataacaagtttccataaactaaaaagcccttggaattttttccaagggcttgagcacgtatttaaaaatttgcgcgttcttctctcatccagactatactgtcggtttcggaatttcaccgaatcagccgcttgcgcgggtcgcggactataccgccggtagggaatctcaccctgccccgaagaattctctttttctttgtcctcattatactatatatgtattctggtttcaatagtgaatctgtttttcacagttcgcttgaatttacctttgtttccgagtataatgaaaataattataggatgttttctatttctataagtgagaattgaggaggaacttattatgattaagtggaacaatttaaacactctttcttcatttgagaatctttcaaaagtagaacgtgtaaaactcgcagaggtaatgtcaggagaaaacggtgcagaccgtgtgaaaaaatacacaattcctatggcagccggtctttcttacaattatgcagcaaaacaggtagatgatgatgtattagaagcattaaccaagttagcggaagaagcacagcttgcagaaaaatttgaagccctctacaatggagaagtcatcaacacaggagaaaaacgtctggttcttcatcacatgacacgtggtcagttaggtgaagcagtagaagcagatggtgtggataaacgtactttctatacagaacagcagaagaaaattgcagattttgcaaataaagtacatgccggtgaaatcacaaatgcagcaggcgagaaatttacaacagtagttcagattggtatcggtggaagtgaccttggtcctcgtgcaatgtatctggcactggaaaactgggctaagaaaaacaatacatttaagatggaagcaaaattcatcagtaatgtagacccggatgatgcagcagcagttttgaattctattgatgttgcacattctatttttgtattggtttccaaatccggaacaactctggaaacactgacaaatgaatcttttgtaaaagatgctctgaaaaatgcaggcttagacgcatccaaacacatgattgcagttacaagtgaaacttctccgcttgctaagagtgatgattatcttgcagcatttttcatggatgactacattggcggtcgtttctcctctacatcagcagtaggtggtgcagttttatctctggcatttggcccggaagtatttgcacagttcttacagggtgcagcagaagaagataaacttgcaatgaataaaaacgtcttagaaaacccggaaatgcttgatgcattaatcggtgtctacgaacgtaacgtattaggatatccgagtacagccgttctgccatactctcaggcactgagccgtttccctgcacatcttcagcagttagatatggaatccaacggtaaatctgtaaaccgttttggtgaagcagtagattatccaaccggtccggttatttttggtgaaccaggaacaaacggacagcactctttctaccagttactgcaccagggaacagacattgtaccgcttcagtttgttggatttaaaaacagccagattggtacagatgttgtaattcaggacagcacaagtcagcagaaactctgcgcaaacgtagcagcacagattgtagcttttgcatgcggaaaagcagatgaaaataaaaacaaaaactttaaaggtggacgtccatccagcattattatcggagaagaactgacaccggaagcacttggtgcactcctcgctcactttgaaaataagattatgttccagggattcgtatggaatgtaaacagctttgaccaggaaggcgtacagcttggtaaagttcttgcaaaacgtgtccttgcacatgaaacagatggcgcattgaaggtattcagtgatttattaaacatctaattctttaattttaaatttttaagagaaagtctgtctgtatagaaaaatcttgcggacaggctttttttaggatgaatgtaaacttataaaaacaaaacggttgacatttaattcttttatggatatactaaattttatacgcaaaaacatcgaaaaatgagaggaaagtatattatgtcagaattatccatcacattacgtttagaaaactgggacgagagcagaccgctgactcgtgaggaagctgttgaaattttaaatcttccggaagaggaaatgccaaaacttctggattgtgcttacgcacttcgtacgaaatataaagggaaaaaagtcagtgtacagctattaacaaatgtgcgtagtggaaactgttcccagaactgtgcgtattgtgcacagtctcgtgattccgaagctccgattgaaaagtatcgcagagtttccgatgaaaaattatacggagataatgatttggtggatgaaaaacatctggcaagacattgtattggcttaagtggaatcggtttctccgatgaagaaattgaagacttggcagatcgtatccgtgaaatgaagaaaaaggaaacacagatttgctgttccatcggatttttaacagagaaacaggcaaaaatgttaaaagaagccgggctggaccgcatcaatcataatttaaacagcagtcgttctttctatccggaaatctgcaccactcatacttatgaacagcgtgtaaacaatattaaaatgcttcagggcttaggttttgaaatctgtagtggcggaattattggaatgggcgaaagcaaagaagatgtagtagatatgttgatggatttaagagaaatcaatccggaatccgtaccgattaattttttacttccaattccgggaacaagactggcagacagagatatttcagaattaacaccggagtattgcctgaaggtgctttgtcttgcaagactgatgatttcaaaatcagatattcgatgtgcagcgggacgtgaagtttatttcaaaggaattgagccgactttatttaaagtagtggattctatctttgcttctggatatctgaccgcaggcggacagggaatcgatgcgacaatgaaaatgatagaagaagccggatttaccggagaaattgaatcgacagatgaagagtaatagagaatcataaagcccaataaagaaataagggaaaagacaaagaagctgaaaaaatcgtttctttgtctttttttgtgctataatcaaaaaaataaaaaataaaaaaacttacaggaaggacgaaaatcattatgaaagaaaaacaaaccggcagttgtgaaagctgtacctattatatttacgatgatgaatatgaaagttatctttgtgatgtcagcatggacgaagatgagtatatgagactggtttccgatacgcattatcagtgtccgtattaccgaaatggaaatgaatatgcagtagtaagaaaacagatgtaaagaacagtagtaacaatatagaagcagaaaaaagcgaatagtaatcacgttagaaaaagaggagagagcgatgacaaaagatttgacgacaggaaaaattatgccgatactggtaaaatttacggtgccgcttgtccttgggaatttatttcagctgacctacaatgcagttgacagtattatcgtgggacattttgtcggaaaagaagcacttgcggcagtcggaatctgcaatcctgtcagtacactgatgattttatttttaaatggactgtgtatgggtgcaagtattttgatggggattcaatatggggcaagggattataaaactttgcaccgccagattagtacaacgatgctttcaggtgttgtattttctgtatttttaacacttatttgtgtcatttttgcggtgccgattttgcggttacttcaggtagacccatcgattctggaaatgacaaaagaatatttgagaattattttctggggactggtatttacttttttatacaactttttttcaagcacccttcgagcactgggagacagcagttctccgttgtattttctgattatcagtgcagttttaaatgtatttggcgatttgttttttgtcgtggtattaaaggctggatgcaatggctgtgcggtttcgacggtattaagtgaagcattgtgctgtttattctgtgtaatttatattcagaaaaaagtgccgattttgcgattgggaaagaaatggctggtgtttgatgcaagtcttttaaagcgaacgattgcttatggatgggcatcggcaatgcagcaggcgacggtacagcttggaaagattgggattcaggcgattgtcaatacgatgggagtttccgttgcggcggcatttgcggtggtaaacagaattgatgattttgcatatacaccggaacaaaatatcgcacatgcgatgacggcactgatggcgcagaacaaaggggcaggaaagaaagaccgtatgcgggaaggattccgttgtggatttatattggaagtgatttatggaattctggttttaattatctgttatgtgtttgcaagaccgcttatgatgctgtttgtaaaagatgaagaggtaatcggtcacggtgtgatttatttacagttgatttcacttatgtatatacttccgggaattacgaatgcacttcagggatttttccgtggaattggagatttgaaagttaccttaatcagcagttttacaaatatgggagtgcgtgtacttgcagccgctccgatggtttttttatggggatttggaattgaagcacttccgtattcttatctggcaggatggattggaatgttacttgtggaagcaccgctgttaattaagatttacaggaagaaataaggcacaagctgaatagaataataaaaaagaaaaataagaaagcagaaatctatgaaattagagcttttgcacatttcaaaacaatatggcaaaaaaacagcagtggaggatatgtctcttgttttgacaaacggcgtgtggagaatttccggaaatcctaaatgtggaaaaacaactctgcttcgtctgattacaggaagcgtgaagccgacagagggaaaactcttttataacgaaagaaatatttttgaagattattcacaatacaaagcagtgcttggttatctgccgcagcattttaaaccggaccatttatttacggtaaaggaatatctgaattatatttcagcttataagggcttatcgaagaaacagacaaaaagaagaactgcagaggcacttggagcacttcgtttgtgggaagtgcgggacaaaaaaatagcgagactttcaagaggaatgagacagagagtcggaatggcacaggcagttttaaataagccgaaggttttagttttagacgaaccttcggcttatttagatgaaagagaagaaaatctgttttatgagctggcaggagaattttttcaaaactgcattgtgattattacagagagaagcagtttggatgagacgagaagcagatgcgaggaagtagcggactggaatctgacgatgaaaaacgggaaagtggggagtatttagaatgaactcaataagtgcgaaattaaaatcggaaataaaacgaacattgtatacaaaatggatttggtttgcaggatttttggcatgtctacttggaaagataacccagatggcaggacaggacagcattacatggaggtgtatttttattgcttcggcaattttaatcagtgaagttttttggctgtttgagctgaaaagcccgaaagatgaggcagtactctgcacgaaatacggaaaccggtggatgcatcaaaaaagagcagtgattctgtgggtgctcgtgttattgattttattaatttccggtttataattttgtcagaataaaacaaagagacattcgatttttttcggatgtctcttttgcatatcaaccgttttacttaatcaatcacttttttgattgcatcaagcagttcgtcataagtttcataagccggaatttccggatattctgctttgattgcttctgtacttttaaataaaaatcctgctttacttgcctgaatcataccaaggtcattatggctgtcaccgcttgcgattgtgtcataaccaatggactgtaatgcttttacagtagtatatttggatttttcacagcgcatcttaaagtctgtgatttctccattttctgcgacaacgagagagttacagaagatggtcggatagccgagttttttcattaaaggtccggcaaactgggagaaggtatcactgataatgataacctgagtcatttctcttaacttgtccaaaaattcctttgcaccgggaatcgggtcaatctttgcgatggtttcctgaatctcttttaatccaaggttgtgttcttttaaaatgtttaagcggtatttcatcagcttatcataatccggctcgtctctggtagtttttttgagttccggaataccggtttcctctgcaaatgcaatccagatttccggtacgagtacgccctctaagtctaagcaaacgatttccattttttcctccattctaaagcaggttgatagggtccattctatcgaaccctgcttttgcttaagtatttatctattcttatcaaaacctattatattagaaaacgaaaaaaaacgccactgaaaattttacgttttaatgcgataaaattttcaatgacgcttagaaatcattttagaatcaaatacaggattcaattaatcttaaaataaatgattgaattgtacttaaatagtggtaggtgattttttatttctcaattggaaaccagccaaagtcaatgcatcttccaaggtcccagctgtcccagccaacccatccaggggtgtttacagtatcggttagcagtttgtagctccagtagaagtatccgcttccggcatcccatgcatctaacatggcttttgcaagtgtgttgtaaatttcttttttcgtttcagcactgatacattcttcgcttaaaccttctacaccatttaatactgtctgtccgcctttggtgtcatgtccaacagcgagagaattgaataagcaccattccccacagataaccgggaagtattcctgcatttctgcaatgtcttttttgagttcttctacataagaaacatagttttctacgttctgttcacagccgttcatctcagcaaccatcaggtactggtgcgtatcaagtacaacgtttttatatttttcttcacgcatgaaatctttccatgcttttaagcggaaggcatcatggaaaacaacgtatttttcttccggcatgtgtttgcggattctgtcgtaagcctccaaataaaaaccgcggataaattccattgtatttggttttgttccctttgctttttcagggtcaactgccggatagcgttctgctacgttcatagattcccacatatcttcaagtataggctcgtttaaaatttcgattccccataagccttttcttgtaccgtatctttttgcaagtctttcaagaacagtgagttcaaattcaacttcgtccggatcctgtgaccatttgcagacaccactgattccgccattatcaaatccgttctggctgtccggtgcagtatgtaagtcgattaaaatctgaagtccatatttttcagcccagttaaatgctttgtcaagttcttcgatacatccgataaagggctctctgtcgccaaagatgaaatacggaacagggattctgactgcatccattcccatcgatttgattcttgtgaaatctctttctgtgatatattcagaacgatggattttgatttttgcctcataaacttctttggaaagttgtgttggaagataatattcatcttcagcagttgttccatcgaataaagatgggctcatccatttttcaagtaccagccagttaccaagattaacaccttttactttcatgtgttctgtttcctttctcttttttaaaaaattttttatttaaaaatgtgattcattgttttttgcaatcgttattttacccatccaaatcttaaatttatatcataattattggaaatttatcacttatattgtgaaaaaatctgtgctataatggaaaagcaaaagaaaatgcaaaaagaaatgcaggaagaagggagcgtgaaaatttgaatatagattatcttgcatggcatgtttcacatgaacttcatacatttgtaagacgctggagcggtgaattaaaaccggataataagccggaaattttttgtgccagaaaggatttaaaagacgattatttttctttttcagagtttgaagattatatgaatcaatgtctggctggaaaatttgtgtctgcgtgtccggtagttttttcggcaggtttaaaagagaatcaagtcgcttatgcctatcttcaggcaggagatttttactatttagtcggaccggtacggtttgattcaaaggttcgtctgtattatcatattggagaatttgaaatcccaaagagcgattttaatgcggtatttagttctgagttttattttttctgttctaatattttactgatgtgtaatctgtttcgcaaggaaattttgacaagggatgatattgtctatgaaaactgtgaagaacagattcgagattcggaaattatggaagaatactcggcacttatctttgaaaggcaggaacttgaagaaccacacaatccttatgaacaggaaattcgagaacttaccagtattgaactgggtgacatcgagatgttgaaaaaaagtattggagaagattatcttggaaagaccggcgtgctttctaaagatgaactgcgcaatacaaaaaatcttggaattgtggttatgacgcttgcgagcagggcggcaattcgaggcggattaatgccggaaatctcgtattccatgagtgatgtctttatccagaaaatcgaagaaatgacagatattgtggcgatttatacggcaatccgtcagtttgaaatggaatatgcaaagctggtggcagaaatccgtaagcaggatgagaaaaaatccaaagaaaagcagagtatctgggtggaagccagcaaagagtatatctttaaacatctgcatgaaaagattcgggtgcaggaaattgcagattacctgcacttaaattccagctatttatctgaactgtttaaacaacaggaatctatgacactgactgattttattttacaggagaaagtaaaactgacgaagaatctgctgacgtattcgccgtattcttacatagagattgcaacttatctgggattttcttcgcagagtcatctgggaaaagtctttaagaaatatacggatatgacccttaggcagtatcgggaacggtatggaagagaacagatacaggaacgaagaaaggcagaattaatatcaaatgaatgaggttgaggagttaaccgaatcaaaaagaaaacagcgaagcggaggaaaaatatccgcttgatacaaaaaagaaagaggaaattaaaaaatgggaaatgacttatttgaaaaagcaccgattccgaaagcttatttcagttttgcgcttccggtggtatttagcatggtgatttcgctggtttataatatggcggacacctattttattgccgctaccggaaatacgaatctggttgcgggtgtttcacttggcgcaccgatttttacgttaatgattgcgcttggtgatatttttggactgggcggaagttcggtgatttcacgactattcggcaaaaaaatggatgaggacggaaagcgtttaagtgtgttctgtttttatggagcaattgtatgcggaattgttgtagcagtgttgatgatgttgttccgtgcaccgattttaactctattaggtgcaaaagcggataccgtgcagtatgcatcggattattatacttggctggtaatcggtgctccgtttattattttatcttttacgccgtctaatctgcttcgaacggaaggattttcagtagcatctatgacaggaacggtgcttggctctgtgattaacattatcttagacccgatttttatcttcgtgcttggcatgggagcagccggtgcagcgatagccacggtaatcggaaacatcggtgcggatttattttttgtatttttcttactgacaaaaagcaaacgtttgtccatcaatccaaaaggattttttatcagcaaaagagaacttggagatatctttgccatcggaataccggcatctgttaccaactttatgcagagtcttggaattgcgctgaccaatcgttttttactggtctatggaacagacaaagtggcttcgatgggaatcgtaatgaaaatcaatatgattgcaatgctgattttagttggctttgcttttggttcacagccgttaatcggatataattatggtgctggaaataaaaagcgtctgaaagcgattctggcatttagttataaatttgaatgtgcaatgggagctgtgctagcacttattttatgtgtttttgcaaagcctttgatttcgatgtttatgaatcaggaaagcatcgtaaatgcaggagttccgatgctcagacttcagcttgcaggtgcagtatttactgcggttacgctcgtaagtacctgtacgttccagtccgccggaaaagcattaaatgcttttcttttatctgtcagcagacagggcgttatctttgcagttgtgatttttattttgtctaaaacagtgggctattatggagtactttcggcacagccggtgtcagattttcttacagctgtgcttgccgtgattctggtgagaaggagcgtataccgagagatacgataaaaaattagaaaataccgttattgtggtttacaaattgtcaaataaaaggtaatatacttttataaaatattttataaaaggaagcttttgtatggcgggaatagagaaaaaaaatgttacaaaatctaaaattgtgaactacattatcaatcataaggcaacgtctaaggtagagttatctaaagatttaaatatcagtatgccgacagtattgtctaatgtaaaagaattgctagcaggtggaattgtgattgaaacaggagaatacgaatcaacaggtgggcgaaaagcgaaaaagattagtattaatcctgcatatcgttatgcggttggaatcagaatcactgcaaagcatatagggtttgtgcttgtaaacatgaagtatgaaattgaaaaatatgaaagaatacgactggaattttcaacaaatacttcttattattcaaaaatcagggaagaattggaggcatttcttaaggatgtagaaaacagggagaggattctgggaatcggtatttcgattcctggaattgttaacttggagaatcgaatgttggtgaaatctcatgctcttcaattagaaaattatagcttgaattttctggaacaggtgttttcactgccggtatactttgagaatgatgcaaatgcagcgatgagagcagaagatttaaatagatataaaaatgcgttgtatttatctttaaataatactttgggtggtgcgttttgtattgatggaaaattaatcttgggagaaaatcagaaggcgggtgagtttgggcatatcattcttgttccaggcggaaagcaatgttattgtggaaagcgtggatgtgcagatgtttactgtgcggcgagcgcactgacggatgataccagccaaacattagaacagtttatgcagcagttagaagaacgaaaggaaagtgcacagcaggtttggcaggaatatttggaatatttagcggttttaatttcaaatttgcggatggcttatgacatggacatcattcttggaggcgaagtgggtggatatctttcagattatatgattccattggaagaaaaagtgatgaaatataatgggtttgaccatgatgcaagatatttgaagatatgttcttataaaagagaagcttctgcagtaggtgtggcaaagtattttttgcaggagtttataaaagatatttagttgcttgtaaaagagaaaaagttccagagagaaagcagtttaaagaatgttttctctctggaactttttttgctttctggaaaaatgcataaattcacagaaacaatcttgtgcaataggcagaattaaacgttgggatattgacaaattttatcttttggataataatgtaattactttaataaaatgtttaataaaagaatataaataaaggaggaaatacattatgttacagcaggtaatgacaaatccaggagaaattattttcagagaggtaccagttccagaggtgaaagacaatcaggtgttggttaaaattatgaatattggaatttgtggttctgatattcatgtataccatggaaaacatccatttacaaaatatccggttacacagggacatgaagtgtctggtgaaattgcaaagattggaaaagatgttacagagtttcgtgaaggacaaaaagtaacaattgagcctcaggtatattgtggagaatgttatccatgtcgtcatggaaaatataatctttgtgaagaactcaaagttatgggatttcagacaacaggaacagcttctgaatattttgcagtagatgcgtcgaaagtaacaccgattccagaggagatgtcttatgaagaaggtgcaatgattgaacctcttgctgtagcagtgcacgctgtaaaacagatgggcgatgtgaaaggaatgaatattgcagtgcttggagcaggtccaattggtaatctggttgctcagtcagcaaaaggaatgggagcagcaaaggttatgattacagatgtcagtgaccttcggttagagaaagcaaaagaatgtggaattgatgtatgtgtcaatacaaaagaaaaagattttggtgaggcaatgattgacgcctttggtccggataaagcagatgtaatttatgactgcgcaggaaataatatcacaatgggtcaggcaatcaaatatgcaagaaaaggaagtgtaattgttcttgtggctgtatttgcaggcatggcaacaattgaccttgcagttgccaacgaccatgaactggatattaagagtacaatgatgtaccgccatgatgattatgtagatgggattgcactcgtaaatgaaggaaaggtacatttaagaccattaatttctaagacttttgcttttaaagattatttgaaagcatatcagtatattgatgataatcgtgaaacaacaatgaaagtaattattaatgtgcaggaaaaatagaacgataaattttggaaggatggggtttagtcagaaacgctgataaggaggaagttatgggaagtgagagtaagaatggaaaagtgccgttgattagtaaaatcgcctatggatttggagatgtaggctgtaattttagctggatgtttgtcagtaactttctaatgattttttataccgatgtgtttggaatcagtatggcagcggtatcagccttgatgcttttttcaagattctgggatgcaatcaatgacccgattgtaggaggactgacagataaaacaaatacaagatgggggaggtatcgcccatggcttctgattgcggctccaattacggcggtgcttttgatgctctccttctgggcacatccagactggtcgaatacagcaaaaatcgtttatatggtaattacatattgccttctggtattaggctatacttgtgtaaatattccgtacggaacactttgtggagctatgacacaggatattgatgaacgtgcaaaaattaatacttcccgttccgtgtcagcgatgattgcaatcggaattattaatattgtgacagtgcctttgattagtaagctaggaagcagtagtgccaaaaaaggctatctgcttgttgcgattatttatggatgtatctttgcagcctgtcatttcttctgctttgcaaagacaaaagaacaggtaacaatccctgaaaaagagaaaatttcaattaaagtacagctgaaagcagttatgcagaataaaccatatctgcttgcactggttggacaggtattgtttggatttacattgtatggaagaaatgctgatattttgtattattttacttatgttgagggaaatgcttcttactataccacctattcaatgtgcattattattccttctattattggtgcagcatgcttccagccagtattccgtaagttaaataataaaggaagaacagcttctatttttgcattacttacaggtatcgcaatgcttgctatgtatttctttaatgtaaaagaatcaccaatcacattttatgcattagccggtattacacaatttttcttttcaggatttaatactgcaatttatgccattattccagactgcgtggaatatggtgagtggaaaacaggacttagaaatgatggattccagtatgcctttgtttctcttggaaataaagttgggatggcagtaggtactgcgtttcttgcagcattacttggaaaatatggatatgtggcaaatcagacacagaatccggaagtaattgcaattatgaaacatgcattttcaacgatacctggaattttgtggattgttacagcaattgttctgtttttctatcgtctgaataaaaaacgctataatgaaattgtggaggacttgaaaaatggcaaaagaggttgatattgtcgctttaggagaacttttgattgattttacagaggcaggaaaaagtgattcaggaaaaaagctgtttgagcaaaatcctggtggcgcaccggcaaatcttttaactctagcctcacgtatggggtatcgcacggaatttatcggtaaagtcggaacggatatgcatgggaattttctgaaaaaaactttggaggaagaaggaatcggaacaaaatatctgatttaggatgaaagatattttacaactcttgcttttgtagagattgcggaaagtggggagcgtcagttttctttttccagaaaacaaagtgcagacacacagctttgtgcagatgagttaaatcagaaattgcttgaagattgtaaggtatttcattttggttcgttgtcattgacagatgaaccggcaagaacagcaacaatagaagctgtaaaaatagcaaaatcatcaggtgcacttatttcttatgaccctaattatcgggcatcattatgggaaaagaaagaaactgctgtagaacagatgaaatccatgataccttatgttgatgtgatgaaagtgtcagatgaagaactagttttgctgacaggaaataaagattatagtcaggcagttaaaatacttcttgatataggaccaaagttagtggctgtgacgtttggaagcgaaggggttcttcttgcaacaaaacagagacaggagaaactaccaggatttaaagtgaaagcgattgatatgacgggggctggagattctttctggggaggcttttaaagtgagtatctaaaacaaaataaaaaaattgaagagcttacatgggaagaacttaaaaagtgtgcaaagtatggcaatgcaacggcggcattgtgtgtgcagagaagaggtggaattccggcaattcctaaaaaagaagaagtagaaagtttgtgtaagtaaatgatgcaaaggggaatgtgaaaaaaatggattttcacgttccctttgatgttttatcgagagatacgataaaaaattatatttaaaaatccaaaaaaatcagttattttatttccaagtaaagataaaatgtacttttgaaatgtactttcaaaacattccaaaagtaaaaaagtacattgaaatatacaggaggaaataaagttatgattcataatccaattttaccaggattccacgcagacccatgtatctgtcgtaaaggggatgacttttacgttgccgtttcttcttttgagtggtttccagggattccgatttatcattcaaaagatatgaaaaactgggaattatattctcatgcgctgacaaatgccgatgactctgatttgaaaaaactgccaagtgcaaagggaatctgggctccgcatctgaccaaacatggtgattattattacattatgtgtgccgaaggtgatacaggatattatcacagtgtgacaatgggtcgttctaaaaacgtatacggaccttatgaggcagacccatgcaatccgattttaacttctgcaccaggaaattataacgaacgtgcagattgggatcatttaaaaccacgttactacaatccagagagcaaacttcagaaatccggtcatgcaagttatgtggatttgccaaatggagaaacctggatggtgcatctgacttccagaccatttgtaccggaacttcgttgtacacttggtcgtgaaactgcaatccagcgcatgaaatagaaataaaaagttccagtttagtttttttaagaactattctggaacttttttgtgcatatcaggaagggttcgtacgaagttgtatattggagataacctccgatgcacactaaaattattaataattggaaaaatacaccgtaatcgtacagatttcgctgtctgttccaacccgcattgccggaccccagacaccgactccggaagttacaatgctgttcagattacctttttttaagtaaccgcagggattttcccagaataattttaccgttagatttccgggaaaaatctgtccatcgtgagtgtgaccgcataactgcatatctacgccggcattatcaagttcttcaagttgttttggctgatgttccaggacaaaaacaggtttggttttatctacgttcgagagcagttcttcgatagtttttcggttcgttgtgccgtctcctggtttttgaatatcttttcggccaacgagataaaaggcattgtcaatacaggtgacttcatcatcgagaagagtgatatcggcatcttttagaaaactttcaaatctcgggtcacggacttcgttttcttttgatgtaactgaaaatccacctaagagccgttctgtcacatcatggtttccgaacacagcataagagccataagtactttgaatcgtagaaagtgttttggcaattttatctggattttgaacggcttcatattcgttgtcaaaaacgtcgcccgcaaatacaacaaggtctgcattttgtgcattgattttctttaccatgcgctgcatctgcctgtcatcgacactgtaaccaagatgcaaatctgcagcgagaacgatttttaaagaatcatgtccggcgcaggatttttctacagtaatatcataaggcgtcacttttacgtgtttggaatgtaaaattccataagcgctgataccgcagataagtgcggtaagcagaagtccaacaaatacatagccggctttacaaaagaaaaactcatgtatttttccagtaatttgttttaaaatcagccggagaatatctgcgactgcaataaacattaataaatataaaaatgtgccaagccagtagttgctgattcgctttacaagtacctgaaattcagaggcaggcagtaaaaatgcaaaaagcagagaaagcgccagcaaagaataaatagtaagataaggcacaacaaaccatttggaatgaaaacgctcagaacatgcagtcagccatttatggattcggtgcaggatgtaggcgtttaataaaatataaatgggaatgatgaatattaaaatcataatagggcttcctttttgtttttcagaatagcacaaatggcaggaagaagcaaatgaagggtgggcatttgatttttgataagaaaagacatataataagtatagctaagaaatgcgattatactctaagtgagtaaaaagaagttcggagtgccagctctgaacttctttttttctgattttttatgctaatccctcaattgcttcttctatgatatcagcaagtttttctgttgtaatttccataaacagtgactgcatcggtccaaatgaatcaataatttccattagttttttgcggtcatgaggattttcttttaattctttatactgaccagcaccatagatgatgcggactggcccttcataaataaaatctttcatgagctacctccaaaataaaatgttatattagtgtgtccgtatagtagaaatattaatatactagggtaacccgagggcaagaaaaattttatcatatctaaagtttacaatgtagaataaaaaggctaaaggtggaagttagttttttatttgaattttcacagaatgttcacaaaaaattagcactcacctcttgacagtgctaataatacgtgctatagtacaattagaacaaaggaagagggaaatagagagagacaaagaaataaaaaagcctttcccctctggtttgacctaagttccaaaaaagaaacaggtaaacagcaattaagattttgagataaaaaaggagagatgacttatgttgatgcctagtatttttggagaaaatttatttgatgacttttgggaattcccattttttgataacagtaaagaacagaaaaacattgaaaagaaactgtatggacatcatagtaaaaatatgatgaaaacagatatcaaagaaactgaaaaaggttacaccattgaaatggatctgccaggatttaagaaagatgaagtcaaagtagcacttgaaaatggttatctgaccatagcagcagcaaaaggacttgataaaaacgagaaagaaaaagaaaccggtcgttacatcagacgtgaacgttattcaggtgcttgtgaacgtagcttttatgtaggagcagatgtaaaacaggaagacatcaaagctcactttgaacatggtatgttaactctgtttgtacctaaaaaagaagcaaaaccggcagtagaaacagataaatatatttccattgaaggataagtagattcctctttaaacaaaattaaaataaattaaaaaaccgccctgtgcacttcgttggagttgagatgcacagggcggttttgatgtaaagcggatattcgtaatccaatttgttacctgattaattcagtcaaataaattttctcttgtaatattctgtgcccatttaccctgacggtaatgatgcagtacccaaggccatttcacaaattcatctgtacataataagaaataaacccagagaaccggaagtttcaggacaaaggcagcgaagaatccaagtggaactgcgtagacccacatatcaatggtatcacagattaatccaaatttggtatcaccaccggctcggaatactccggcaatgagtgcggtatttacagccgaacccataatataataagtgttaattaagagcatatattttaagtagtgcattgcctgatcatttagagaggcaaatctcattacaaaaggtgtgattgtcagtacgatgacaccaccgattgctccggcaatcacagtcatttttaacattctggatgcataaactttagatttttccaagtcaccttttcccataacattgccaagcagaatggttcctgcactggcaatcgcaaaacagaacacggaaccaatgttacggactactgtaaccagagaattagcagctacagcatcggtacctaaatgtccaagaataacagaatacatggaaaaggctacactccatgagacatcgtttccaagtgccggaagtgataatttaataaagtcgtttaataaaactttactatggataaacatataagccggatttagttttacgtttttactcagaaaagaaacaatgatgcaggcaattagttcgattagtcgagaaaaagcagttgcaatggcaacaccggctgctccgagttttggaagtccaaataaaccaaaaataaagaccgcatttaaaataacatttaaaacaaaagcaagcatatttaatgccatactgatggttacccgtccgatacttcgcagaattgcaagataaacttcggtcacgccccagcataaataagtaattcccatgattcttaaataagaagagccgatggatattaactctgggtcagaggtaaagattagcatcatgcggtttggcatcgtaaatgcaatcagggcaacgacaccggaaattgcgattgaaaaacgaagggcaattccttcgattgcgtgaatcgcctgtaaattattttgtccaaagtattgtgcacataaaagcgatgcacctgtgccaagtccataatataccataaacaggatattagaataactggcagctaaagaaactgcggaaattgcggattgtccgacataattgagcatgattacgtcggcggaattgacggctgcacttaacagattttggatgataatcggaagtgtcagccgaaacatttgccggtaaaagtcatctttaccggttgaaactatatttttcataaaaatcccccataaattattataaaatttattataatgtatttgagagaaaatttcgtcctttattctgacggatttctacgttattttgactgtgatgtttcttctgtctgcagggttcacagaattttcacaaaaaattagcactcatctcttgacagtgctaataatacgtgctatagtacaactagaacaaaggaagagggaaatagagagagacaaagaaataaaaaagtctttcccctctggtttgacccaagttccaaaaaaagaaacaggtaaacagcaattaagattttgagataaaaaaggagagatgacttatgttgatgcctagtatttttggagaaaatttatttgatgacttttgggaattcccattttttgataacagtaaagaacagaaaaacattgaaaagaaactgtatggacatcatagcaaaaatatgatgaaaacagatatcaaagaaactgaaaaaggttataccattgaaatggatctgccaggatttaagaaagatgaagtcaaagtagcacttgaaaatggttatctgaccatagcagcagcaaaaggacttgataaagacgagaaagaaaaagaaaccggtcgttacatcagacgtgaacgttattcaggcgcctgtgaacgtagtttttatgtgggagaagatgtgaaacaggaagacatcaaagctcactttgaacatggtatgctgaccctgttcgtaccaaagaaagaagcaaaaccggcagtggaaacagataaatacatttccattgaaggataaaaacattccttttagataaagacagataagtaaaacgccctgtgtattttttaaaaaaagagatgcacagggcgtttttttgcacttactcaaaataagttgacatttaaatttaaaatatttataattctaattgtttgaattataaatattttggctaaaagaggaggggaatttatggatgattcattacactatctgattatggcaaatcagatgcttgttcagcgtggtctgttagagcggttaaaggaaaccggacttacaattggtcagccaaaggtgctggattatttaaaggagcatgatggaagtaatcagaaagaaattgccagggcgtgttttttggaggcgggttctttgacttcaattttaaaccgcatggaagaaaaaggactggttgagaggcgcatgttaaatggaaatcggcgcagttttcatgtatttctgacagaaaacggaaaaaaaaatcaggaactggtggaagaaatgtttgcggagattgagaaagatgcactggatggaatttcatcagaagaatttgaaactttcatggaagtatatcggaagatttatggaaatcttttacaggcagaacgaaagacagagaaagaaggaaaaatgaaaaatgaataaattaaaacgatatcttttatttttagtaggattatttgtaaatgcactgggagtcagtcttgtcacaaaagcaaatctgggaacttccccgatttcatcgattccttatgtattaagtttgaatttcccatttactttgggtaactttacaattttttttagtatttttttgattgtgttgcagattttaattttaagaaaaaactttaaactggaaaatattttgcagataccggtatccattgcatttggatattttattgacttgacgatgtatctgtttttctgggtagacccacagaattatctgttgaaaattgtggcactgttgattggatgtggagtgttaggatttggtgtttatttagaagtggtcgcagatgtggtgatgcttccaggagaatcctttgtccgtgcaattgtgcagacctggaacacaaattttggaacaacaaagattatctttgatacttccatggcggtgattgcagcagcgttatcttttgtgtttgccggaaaattaaacggagtcagagaaggtacaattattgcggcacttttagttggatttattgcaagactgcttggaaagaaacttgagtttattaagttattcttattcccggaggaatatagaaaccaagaagaaattgaagaagcagatgagacagaagcagagcagaagtcaaagaacgtaattgtgatcggcagatagtatggaagtggtggacacgaaaatgaattacatagaagagtgtataaaaaaagcaatgtaaattaaagcagaaaagcagtaattttatccggaagtcttggtataatcaacttatgaaattttgtatgaaaaataaagatgtactttcggaatcatatcaaagctttcaagagtacatgaaaaagattgggaggaatcagtatgccaaaacgcttctgtaataaaagaaaaaaacagcttcggaattaagtttccggagctgttttttctataaaatcaagatatttaagacattcatccttatgtggagcatttttgataattccaacatagatatccccatcaaattttgcattttttaaaagtggaaaatccgagacattgatactgtcagagagatatccttttttatttaattgttccattgcttctcgattcataaatacgaggtctattttttttgcgtcaattgcagcaagaagtctggtgcttgatgcataagcgtattctaagttttccgagtctggattctcctgtatcagtaaattgtcataagtacagatttcatttttctttgcagataaatgttcaaagtctaaaaaatcactggtcagatgctgagagagagattcgctcatattaacattaataaatgcaatcgagagaacagttgttttttttacaagctgtccgtggatattataaacaagaatataaagtacgatgcaaataataataaaaggcagtttgtaataatcccaaagatattgaagttttgcttttccgtgaagttgttttaatgctttcatagaacatcatccttattattttcaagtcgttccagaatcggaagaatcagccaggagcagataagtgctccgagtccttgtccaaaaacaataaatggtgtgaaaatattgattataacatagtaaataacaaaataaacaactgccatcaaaatagaacagaacagataacgcagtcccatgacaagtgcatttttaaaagttgcaggaattgtattttcaaatcgtgcaaataatggaaaaacattcagtaaaacgataaggtatacaactccggcacagatgagcactgcaccgcataaagtccagaatacattttccagacgaatatgataaagcacatagccgtcaattccaaataggatgccaagccccaaaagagggagccagatcagtgtggcttttttgaaattagaacgaaatgcagtaaagaactgctttgtaatattgccttcttcattgcgtacgagtttgaatgaaacataataaagggcagttgtcgaggcaccgattgtaaaaacaggaatacaacataaaaaccaaagggtattgagccatgcagcacaaaaaattttgtttaaaagctggatgaaacgattatcaattgaaaaaatctgattcataatattctcctttacttggttggagcaatgtttacggattctcggtatacaatgtttgtttcggtataaacggttcgataatttaaagtcggatcttttattctggagagcaataaatctattgcacaaactccaagaatttcattgtgaatgtggatactggtaagcggtggagtgataagtttagcagcaggagaatcgtcaaagccacatagacaaatatcctccggaacttgaatatttaattgtcttaatatttgcatcagatcaaaagcaataaaatcatttgcacagacaaaaacatcaggaagttcttttaaattttgaatatagttaaaaagataagttttataatctgtgagtgtgtcttttggagcgtctataataaaaaactcttcattaattggaagcgaatttatatagagtgcattacgagtagccatgcagcgttcaaaaaaagattggcaatgcaactgctcgccgataaatccgatatttgttttgccacattttttcatttcacgaacgaaggcaaaaatttcatcctggttattcataagtaaacgatcagcaggaagaggttttcccataagtaccggatggtctacaaataaaaccggaatatccagattgcaaatcatttttgcgtagtcatagttaaaagtttcaatacagataatgccacagacattctcaggatgaaacgaattgggaagctggtagttggcttgttcttcattgcttacgcggtgcatcgtaatgatatagccaagttgagtggtttctctttgaatcttatctaacattgtagaagaaaaatgaaaattatcgagcggagcgcaggttaggattgcaatttcaccatgaggcttttgtggagttgcttcttgtgaggaaaacttaagttgttctgggttcatataggtaaattgtttatagcccatttctaccgttttttgtaacactttttctctggttgaatcagataagactcctgtgttgttgatggcttttgagacggtatttcttgatagtccaagagcatcagcgatatcttgtatcgtcacacgttttgacataataaaatctccttttcagttctaaaacaataattggactgttacaaatgtaaaataattatatgagtttattatagaataaatttgcgaatgtgtcaaatgtaaaataaatagtaaaaataaacaaaaaaacaaggaaaaatgagggaaaaacagcatatagcatcgtgaaattcttacaaaagtgtgcgtatgtaacaataaatagttgacatttgagtataaaattgatattatgatgacataagcaaaacatgttatgtttacaaatgcacacattctgtagaaggaggaaagaaaatggaacagaaaaagaaatctggattcggtaatacggttgcatatgtgaaacgtcattggcagttgtatgtattctttttattaccggcattgttgctcactttgatttttaagtatattcctatgggcggcgttttaattgcatttatggattataacccggttcgagggattcttggaagtgattgggttggactggaacatttcagaagatttttatcatcaccggactttatgagatatttagtaaacacattgaagcttagtgtgtatggcttattgtggggctttccggtgccgattttacttgcatttttgttaaatcgaattgttagtaaaagaaagaagaaaaatattcagctcgtgctgtatcttccgaactttatttctgtcattgtattatgtggtattgtacgaatcttcttgtctgtaacaggaccggtaaacggattgtttggaacaagtatcaactttatgacaatgccgtctgcttttcgtacgatttacattgccagtggaatttggcagggggcaggctgggcttcgattctgtatacagcagcactatcaaatgcaagtcaggagttaaaagaagcggcagtaattgatggagcaaatattttccaacagattaaagcggtggaatggccagccatcaaagatattgtattaattcagttaatcatgcaagttggaaacattttaagtattggttttgaaaaagcctatgcacttcaaaccgatttaaaccttcctacatctgagattatttcgacatacgtatataagaaaggtttgattgatggagattatggattttcaaccgcagttggcttatttaatacggtaatcaatgtcatcttattaattgcagtaaataaaatcgttaaaaaaatgaacgatggaaagggaatttaggaggtgtgagtatgaaggcgaagagaaaaagtcaattttccaaatatggccgacaagataaaattattttatcgattggatattttttaattgcattgtttgtacttgcaattattgtgccaattttttacatcatagttgcatcttttatggatccggtaacattacagaataaaggaattacatttgatttttcaaaatggacgataacagcgtatcaaagggttatgtcaaatggagcaatctggattggttttaaaaacgcagttatttattccgttgtatttacagtagtatctgttgtggttacattacttgccgcatatccaatgtcacgtacggatttcaaggggagaaaattatttaatgttatttttgtaatcacaatgttttttggcggaggtttaattccgacatacttattgatttcaaatcttggtttattagacagtatgtgggcggttatccttccgggtgcatttagtgtatggaacatgattattgcaagaacgtattatcagggaattccgggagagttaagagaagcggcagaagtagatggggcaaatgagttggtattcttctttaaaatactgcttccggtttgcacaccgatcattgcgacaatcgcattgtggcagtttgttggtatgtggaacagttactttgatgcaatgatttatttaaatgattctgcgaaacagccgttacagttagttttgcggtccattttgattcagaaccagccggaatccggcatgatttctgatatgcaaagtaccgcacagagggcacagcttgcagagttattaaaatatgcaacaattattatatcgagtctgcctcttttagtaatgtatccatttttccagaagtatttcgatagtggaatcatggcaggttcagtaaaaggttgatgtaggagggtaaagatgaaaaaaagaacgaaaaaagtatggaaaagaacagcagctatggcattagcagtggcaatggcagcaacgacagttactggatgtggaagtggtaaatccagtgcaaaattaaatgatggaagctttaaagaagtggatgcgtctactctggaatttccgttaaaagagaaagcaactttaaccggaacaattagttatccggcaaatacagaatctgaaccgaataagagaacgatttttaaaagacttcaggaaaagacgaatgtagaaattgactggacggcgattcaggcagatcagtggagtgataaaatttctctggaaatggcaaatacaaaaaatatgacagattttatcttttcagcgggattcagcgataatgacttgttaaaatatgccaaacaaggtgtaatcattccgttggaagaatatattgacgcatatatgccgaatttacaggcagtttttgaaaaatatccggaatatcgaaccatgtgtactgatacagatggacacatctgggcacttccatggattgaacagcttggaaatgaaaagacagcaattcagacaatcggaaatatgagttttattaataaaaaatggctggatttcttaaatcttaaagttccgacaaccgtagatgaatttgaacaggtattaattgcgttccgcgatcatgcatctgaaattcaggcagagtttggaattgatggaagcattattccgatgtcttgcattgtaaatgatggagaccaggatccgagtttaattatcaatggctttggagaagggtatggagatgcagataaaacaagacatattgcagtgacaaatgataaagaagtcatctgttctgcaacacaggatggatacaaagaaggtattgaatggctgcacaaattgtatgaagaaggcttaattgatacagaaagttttacacaggaatggtctacttatgtagcaaaaggaaaatccggacgttatggtgtttgctttagctgggatgtggcaaatattgataacttagaagactgggttccgcttccggcattaacagcagatacaagaaatattactcctcagaatggttctttcacaagtggatttgacagaggaagatgtgttgtaacagcagtagcagaaaatccggcacttgtttgtgcatggttagaccagatgtatgacccattccagtctccacagaataactggggaacttatggtgaagacgatgactttgatatctttgaactcagcaagaatgcagagggtggagaaatgctcaagcatgcaccgcttggagatgcttcaccggtagaagttcgtgaagcagaatcagttggaggtccgcttgcagtattaaatgattactatgatgtttatgtgacctgcccggatgatgcacaatatcgtttagactggattaaagaatattatacaccggatatgaacctggattatgtatatccaaatgtatttatgaatcaggaagatacaaagaaattgtctgaccttcagactgatattgaaaaattaatcaatgcaaacaaatccgattggattatgaatggatttacagatgatgactggaaccagtacttaagtgaattagacggatatggtctggaagaatatctgcagattttccagaaatatctggatgactattatgcagatagtgccaaataaagagaaaagataaggcgagaggctgcgtaacaaaactgcgcagtctcttttttgaaattttttttggaggaaaaggaatgattaacgataaattaaaaaaggcgagagaatatgaagtacggaaagaaaaagaaattgctccagataaaagaccggcgtttcacctgactccaagagtcggctggatgaatgacccgaatggattttcttatcataatggagagtatcatttgttttatcagtatcatccgtatggtacaaactggggaccaatgcactggggacatgcagtaagtaaagatttattaaaatgggaatattgtccgacagcacttgcaccagatgaaagttatgataattttggatgtttttcgggaagtgcggatactttggatgacggaaggcagattcttatgtatacaggtgttcaaagcacaaaagatgaagatggaaaagagattgtgtttcagactcaatgtattgcagttggagatggaacaaattttgaaaaatatgaaaaaaatccagtaattactgcagatgctttaccggaaggcgcaagtaaaattgatttccgtgacccgaaaatctggaaagaaaaagatggaacatttcgctgtgtagttggaagcagaccggcagatggaagtggacagatcttattatatagcagcaaagatggattttcctggaactttgaacagattttgattcaaaacaaaaatcgttttggaaaaatgtgggagtgcccggatttctttgaagtggatggaaaatggctgttgatggtcagccctcaggatatgatgccggtaggcctggaatatggagcaggaaatggaacattatgcgtagcaggtcatttggacgaaaacaaacatttggtagaagaatatacacagtcgattgattatggaattgatttttatgcaccgcagactgttttagcaccggatggaagacgtattatgattggctggatgcagaactgggatacctgtggagtacgggaagatgacatgaaatggtttggtcagacaagctgtccgagagaaattcagtttgtagatggaaaactgattcagaatccaattcgtgaattgagcaattatcataagaataccgtttcttattcagaagtgcttatatctgactgtatttctttagaaaaagtcagcggaagaatgattgacctggaagtagaaattaaaccggaagatgaagaaaattgttatgataaatttgtaatccaatttgccaaaaacgagagcttccattcggatattgtattttatccaaaggaatctgttctggaaattgaccgtagctggtcaggtatcagaagagccgtacagcatcagaaaaaatgtaaagtggcagataataacggaagtataaaattacgagtgattcttgacagatacagcgtagaagtttttgtaaatgatggagaacaggcaatgtcaatggcagtatttacagaacaatgtgcagatgaaatttgcttttatgcagagggaaaagtgaaagctaatgtgacaaaaagtgatttggaattttaaaaaagagttgattttagaaaaattttaatctaagaaagctgggctaagaaaatgacagatgtaaccgcattgggagaattattaattgatttcacagaaaatggaatcagtgagcagggaaatccaattttagaagccaatccaggaggcgcaccatgtaatgtgctggcaatgcttaccaaacttgggaaccagacattatttatcggaaaagttggaaatgacagtctgggaaagatgctaaaagataaggtaacagcactgggaatagatacaacttatctgtatcaggatgagatagtgcatacgacacttgcttttgtacatactgcagaagatggagacagagaattttcattctatcgaaatccaggcgcagatatgatgcttcgtgcagaagaagtgaatgaagaagcaataaaagaatcaaaaatttttcactttggaacgctttcgatgactcatgaaggagtacgcacagcaaccaaaaaggcagtggaaacagcaaaacaaaatcaggttttaatttcctttgacccgaatttaagagagccattgtgggatagtttagatgaggcaaggaaacaggtttcttatggaatgagtatgtgcgatatcctgaaaatttcggataatgaaattgaatggtataccggagaaagcgactatacaaaagcagttgagaaaatcttggaaaactatcagattccgctgattctggtttccatgggaaaacagggaagccgtgcatattataaaaatcagatggtagaagtaccggcgattcttcagaaaaatacaatcgagacaacgggtgcgggggatacctttgatgcctgtgtattagactatattttaaaacatggactggaaaatttgtctgaacaaagtttaaaggaaatgcttacttttgcaaacgcagcagcgtcgattgtcacaaccagaaaaggggcactttgcgtgatgccatcaaaagaagacgtagaagaaattttgaaaaaataagaaatgagccagcaggagtttgaaaacgtgttgagcagagattaatcgaaaaattttgacaggtgaagtctgaaaaaaaacaggagaacaataatgccaacgccacataaggatgttttggtttaatgcctatacggtgcaactcagaaatgggttgcaccgtttttcttattatgcgataaaacgaaaccgctgaggatttttttgcatttcttccatcattgcaagaatttcttgttcagtcggaatatcaatcattccaacagcagtgaaatacacatcaacttttacataacagtgaccgctggatttatcgttattatgaacttcaattcgttcaataagtgtatttacaagcgtgggtgtaagttccttaatttctgtaatttcacggagagtatgtagcaataacctgaggtcggtaactttctgtcctacatcatctaatgccgctttccattcttctatttctgtctgtaaccgtttttgctcacactcataattttgaagcaatttggaaaagcgttcatccgaaaggattccggcagcgttttgctcaaatactttctcaattaacttgtcaatttccgatattctctttccaccacgctcaattgataatctgagttttttattctccgtttgtcgtacaagatttgttttcttggcaagcatatacaaaaatgcggactcgtagcactttacaaaatctgccaagctccttatagattcaagtacaatctgttctaacgatatatctctgatatagtgaatttggcattcacctctgccgcttttgtaatttgagcatcgccaaaattcttgatttcgtttaagacttttcgctgcataaaagtgtaatttagctccgcaatcaggacaatataccaaacctgaaaacaagctttgtcttcctgttgctgtaggtcggtggcgatgttttctcaattcctgtaccctaagccactgttcttcagatataatcggctcttgcatattgggaataatttgatattcttcagtaggattatgaattaccttatgaaccttatagctgacagtcgtgctttgaagtttaccgcacaaccggtgtattgcctgttttcaagaatatttacaacagttttctgatcccatttgcaagaatcgcaaggcactttctgtgtgttttttttccgatactttcataatatgccgatggaataagtatattttccttttctaactgctttgcaatttgtagcggtcctcgacctgcaagacataaagaatagattttgcgtacaatattggcagcgggttcatcaattatccattgttctttgttatctgggcttttcatatatccgaacggaactgttgtagaaacacgcttaccatgctccgctttggattgccatacagcacggattttcttagaggtttgtgcagcataccattcattaaaaatattgtaaaacggaagcatttccataccgtcaccggttgtgctgtttacattttcctgaatggaaataaatgtgatacctaaggaaggatatacaatttgtgtgagtcttccggcttcaacctgttctcttccgaaacaggaaaggtctttaacaataatcctacaaattttaccttcctcagccattctttgcatacgctggaagtcacttcgttcaaaacttgtaccggaaatcccgtcatctacaaagaacattgtatttttgtagccgtgatttttacaataatcaagcaagatttgtttctgattacttatactgtttgattcatcatcggatacccttttatctttttcatcctcgacagataatctgcaataaagggcagtgatgagctcatcgtttgtttctgctgtcataattttacgctcctttccgacaacaggacataacaaagatatatttattttattacgccctgtgtcttttggctattgtatgaatatcaaattggcttttcaggcaatatcagtttctgaaattgctgaagaacattttctctgccattgggattaaaatgtgtgctgacttcgtaagttgtattgcctattttcataaagaacggttcatcattcttttcaaaatacggtgcatatattgatttgtttttatctgtcatcgttcatccctcctgtttctttctctttgcttctgccatttttcgagcagagatattattgttttctgcatatcggatttggtgtagtttttcggaaaatatttgcgtatatcttcttccataaaacgaacctgttctttttgattgggcttttcttcacacaaaacggcaaacacaacatcggttgaatatttgccttattcactgaattttctcaatcgctgtgcttgtgataatgacggtgtagcgtctgtaaattcgatttggtcaagcaatattctttgctcatattccgatagatatgaaatctcaaccgcaggagtaaaggctaaccgttccttgtccacaagttttaagagctcaggtattaagtatgtcaggcgaatatatcgctgtacttgtctgccactttctgtgtcagatatgttatctcttgacttgtggacaacttgtccataagtttttccctgatgctttaaggcttctaatttcattttgtaggcaaaggatttttcgcttggtaagatatgttcacggtgtacgtttgaatccaccatttgcacaatcgcctcatcttttgtcagttcttttattatcacgggtatgcttgttacacctaatgctttgcaagcttcagctcgtctgtgtccgctgataatttcgtatttaccagccggaaaaggacgggcaattatcggttcaagcaatccattttcttttatgctctctgttaattcttgttgctcaattccgcttctttccttaaacggatgattttcaaagggaacaagcgagtctatatctattatctgtatcatttggctatctcctatatattttcttcttcggcaagtaatgtcttactctataagtcttaataccttctgttattcggaaatcaagaaagctgaaaatcagaattgttttagatagataatgcttggctttccctgaccttgtcttttacgaagaatcaaatccgcagtttcaagttcagaaaacaacttacatattttttcgtgaccgaaatgcagtttttcctgagcggattttattgtgcaatattgatatactctgccttgtttatctatccagccgtttttgacggacagatacattcggtcaagtaaaagtccgtacagcattttggcgtctgttgaaactgatttgtacttttcttcaaataacgctttaggtactttgtagaatgcaaagtttttggcattcgatgttttgaaatatctgttcactgtgttacctccgtttctgtactgatttggtgccgaaatcggcaattctttcgcttatatgagcttgaaattctttgtaagtgttatttatcatcttttgtaattacgctcctttttgccttgaatttgcggcagtaaacaataatgacacgataactttgtttgcaatcgctatgacattttctgcaaagcttgttgtatgttcttctacctgtattgggggttatgaaaaatttccattcttgttttgctttctttgataatctcggcattataaaaactcctttcactcatttggacaaagggtgccaaaatgcacacccaaatcggataattaaaaagaaaaatacttttcagcgcataaaccatcagggggttccttgaactcttataaaatttattccttcacttattaggaatttctttgtgttttgcccccttgttttgtaaaaataaagacccatctgtaaaaaagtacagatgggtagaaatccatattattttctgctataataatgctatctcatcgacatagaattattaggagatgaaacatgagttattcagacgaaataaagaaaattcgtaaaaaatgttttctgtctcaagaagcttttgggagagaaattggagtttccttttcatcaataaaccgttgggaaggtggaaaaagcaaaccgaatatggctgctatgaaaaaacttaaagatttttgtgatattcatggtattgactttaccgccttggaagaacaatggaacaatttgggaaaggacaactaaaattatggcaaagaaaaagacagaggatacaatcaatctcgattcaattctttttaaatgtagagacatcttacgtgcagcacgtaattcgggttcattttttgaaaaacgtgatatgatgctgacactggtatttttaagatttatcggagaaaaatatgaggatggtatcgaaaaattacgccaaatcttaattgaacaagggcttgatccggatgatgaaaacattcgtgcagcattctttgatgatgccacatttgcagatggcacatataatctatcgcctgaggcaagatggtcaacaattataaatacacctgctcccaaactgaatgttgcattagacaatgcacttcatagtattgctgccagttctaagcaattaaaagggtgctttgtggaaggtacatttactacacgcaatcttgcaccgaatgatatcaaaaaactgattgatgaagtcaataaaatcagccataagaagttcggagaagaaaaagaccttattggtcgtgtttatgaatattttctgaaagaatttgctgttaatgccactaaagaagaaggtgaattctatacaccgcacgatgttgtacagctaattgcaactatgattgaaccgtatgacggcacgctgtatgacccttgctgtggttctggtggtatgtttattcaaagtgctgcactcgtaaaatctaaacaaggcgatattaaccgtatcaatgtatatgggcaggaaaaagaacctgcaacatatcgtcttgcaaaaatgaaccttgccttgcgcggcatcagccataaccttggcgaaaccagtgattccagctttctgaatgacctgcacaaggggttgtacttcgattacattatggcaaatccgccatttaacctcaaaagctggtatgacagtaccttggagcatgaccctcgctgggcggattaccagacgccgccggagagcaacggcaactatgcgtggattctacatatcctctcgcacctgaaaaagcagtccggcgtgtctggtttcctgcttgccaacggcgcactgaacgacagtgacacattggaaattcgcaaaaagctgatccaaaatgataaggtggaagcaatcatcgtcctgccgagagaactattcatcaccacagacatcagcgttaccctttggattttgaaccagaacaaaaagggcggtagctaccacggcagaaatctgcgtaaccgtgaacacgagattttattcatggacctgcgtagctggacggaaaacccggtaaagggcgagaacaagaagaaagtcctgctggacagcactcaaatcggaaaagccgccgacatctaccacacatggcagagcgagggcacggacggcagctgctatgaggtgccggagctgtaccgcagtgtgggtattgatgagattgagcagaacaactgggcgctgaccccgagcaagtatattgagttcatcgaccacgatctggaaatcgactatgaaaaggaaatggctcgtatccagtcggaaatgcaggaggtcatgaagcaggaaaagaaatcccagcagatgctggaagatgcattcagggggattggctatgggattgagtaaatataaattaggcaattgtgtcgaattatattccgaacgctgtaacataccaaatcttacagaatgggatgtgtctggcgtaaatagggataaggagtttttcgagccttcaaagcaagtcggcgaaaatacaagtaattataaagtggtgccagtggattattttgcctgtaacttaatgcacgtaggtagagataaagtgctaccaattgccctgaatcatactaacaaagaaaaatatgtgagtccagcttataccgtttttaagattaaggaaaatgctcagattctgaaggagtatttctttataatgctgaaatccaatgaacaggatagatatttctggtttcatacagattcctctattagagatggtatgtcgtgggaggatttttgtgaccttgagattagcattccgccgcttgtcatccagcagaaatatgtagctgtctacaacgccatgcttgccaaccagcaaagctatgagcgtggattggaggacttgaggttaacttgtgatgcgtatatagaccagctcaggaacaaatataaatcacaaaaacttggagcctttatttccatgtgtgaagaaaagaacgaaggactgcaatacagtattgatgatgttaaaggcatatctattgaaaagaaatttattgatacaaaagccaatatggaaggtgtgtcgcttcgcccgtatgcagttataaagccagacgaatttgcctatgtgacagtcacatcaaggaatggtggtaaaatttctctggcacacaataatacgcaaaatacttatatctgttcttcttcctatatcgtttttacgataactgatacagatacgctattgccaagctactttgccatgctttttaggcgtagtgaatttgaccgttacgctcgttttcattcctggggaagtgcgagagaaacatttgattgggaagaaatgtgtgatgtggaaattcccgtaccgcctatagagattcaacaagatattgtgaacatttatgaagtatatttagccagaaaagaaattaatgaaaagctcaaaagtcaaattaaggatatttgtccaatcttaattaaaggttctattgaagaatcaagtagatgaaaggaagtgtgacgtatggcaaagctgaataattataacggtcgctattgcgagtcggaatatgaaagtgctttcatcgcttttttgcagtcggttggttggacgtatctgccgggaaataagattaaacgctgttacagagacgtgcttattgcagatgatttcagagcatttattacaaaagcaaatacagacttgttggaagaagaaattgagcaaatttatgatactgttcgccttgtcggtgcagagagtgattttgccactttgcataaggtctataaatggatggttgacggtattcaattcacaccgcaaagtggtttaccaatacaggttactcttattgattttgaaacaccagaaaacaatatatttcatgtagtaaatcagctaacagtagactatataaataacggacaacgtgaaaaccgccgaccggatgtgcttttgtatgtaaatggcatgccactatgcattatcgaattaaagaatcctgccgattctcattctacaatttatgacgcatgggagcagattaccattcgctactggcgtgatattccgcatttgctacattattgccctttagcgtgtatctctgatggagttaaaacaagattaggaacggtacgcacaccttatgaacatttctatgcttggagacgtgcaaacgatgctgataagatttctaccatgccttttgcagaaaccgaaactatgattaagggtgtgtatgcacctgagcgtttcttggaaatattccgtgattacatttattttcaagatgaaattttcgattgtgatgaacgtgaaattgtttgccgttatccgcagttctttgctgcaagactgcttaaacagagtattataaaatccgttatggagcaaacaggaaaaggcggtacatattttggtgcaaccggatgcggaaaaacatacactatggcgtttcttgccagacagctttcacttcgctgcactgatattcctgaaattggctctccgactatcgttatgattgttgaccgtgatgaacttcaggaacagggaattaagctatttgccaagagcaaagaatttttaaacctcggtgaagtttctatagttaaaagtaggaataacctcagacaagaacttggcagcagagaaagcggtggcttttatatttgcactatccagaaattttgcgaccgtaaggaagataaaattggtctcattaatgagcgacataatattatttgtttttctgacgaagcacatagaacgcagttggagcattcaagaaaaattcagtttagtaaagatgccgatgaaaacatgaaagctatggtttctaagccatatgcaaaggtgttaaaggaagcatttccacatgctacatttgttggatttaccggtactcctattgcagaaacttaccaaacttttggcgatgaaattgaccgctatacgatggaccaagctgttgcagatggattaactgtatctatcaaatatcatccgagaattgcgaaagtccttttagataccaaaaaagtcaaagaaattgagacttattataaaacttgtgctgatgatggtgctaccgaggaagatattgaagcaagtaaaaaagctatgagttccatggaaattattcttggagagccttcccgtttggaacgtcttgctgtagatattcatgatcattatgtatctgcttgcgataaagaacctgacagaatacaaaaagcgatgattgtttgttctaacagaaaaattgcttatgagttactcagaaaatttagagataaatatccagaatggtttgaagaaaagaaaattcccgatggcatagaagctataaaggaagaacttgatgaattaaaacctatgccgtttatggctatggttgccagtgttggcagcaacgatgagaaagaaatgtataattaccttggcggtgtaaaaaatgatagacgctcaaaggaattagatgctgcctttaagcaggaaaaatctaacttccgtatagttattgttgttgatatgtggattactggttttgatgttccaagtcttacgtatctatataatgataagcctctaaaaaaacatctgcttattcaaacaattagtcgtgttaatagggtttatccaggaaagaaatttggtatggtcattgactatatcggaatccgtgataatatgcgtgaagctatgaaaatttatggcggagatacatctgttgcacccaccgaggatgatgtagaacaggctacccaagtttttagagaagaacttgaaattttaaagactatgtttaccggatacgatttgaaaccatttttaaatccgaacggagattctgtagaacgttattgcttgcttgccaaagctgcggagtacgtgttttcttctacagaggaattaaattctgaaggtaaaaacggtacacaaaaggtatcatttaaaacctattttttaaagactgttagaagagtgcgtcttggctacgatattgctcaaccatctggcgatttatctgacagtgaatccgctttggcacaatgctttatggcaattgctggttttgttcgcaaaatgagtggtacaactgagcttgatacagacagtatgaatcgtgctgtttctaaaatggtcgacgaggcattacgttacaatcaagtggagagtgtccttgatgctggggaggaagaggatatctttagcccggagtattttgaaaagctttctgatgtaaaaatgcctgccaccaagctagagctacttataaaaatgattcgcaaacagattaaagaatacagtaagattaacaagattgctgcaaagacttatcaggaaatgcttgaagaaacgattgctatatatcatgaaagacgaaaacatattagtgcagaagaagctggagctacacaagaacaggcatctgaagatattattaaaaatgccacggaacaagcattacagatactccgtcaaatgaacgaaagccgtgaaagtttccgtaaaattggtttaacctttgaggaaaaagcattttacgatattttagtatccttacgagaccagtataattttgaatatggcgaggataaagacattggtggtatgattgtaaatgatagatgtaaaagtcttgccaaaaaagtgaaagagataattgatacaaaatcttctttttctgattggcttaacaaccaaaatgtacgcaatcagctcaaacttgatattaaaatttgtctcgtaaagaacggctatccacctcaatatagtccagaggtttttacaaaagttatggaacaagtagagaattttgaagaaaattccgatatgcctttggctactacttatacatttccacaatctcgtactgtatctatggtagcggaagatatcattccatatggaaataaatcggagaattgatgaggaacggaaatgaaagcaaaaaaatggctaactattattacattggttattacagccttgtcattagttcttgcctttatcattggcaagaatagtaattgtataacttatgacatatctatggcgattttcggcggagctgctcttggctttataatgtcattaacagaatattatgttgaaagacgaaaagcaatggaagaattttggcttcaggcaaccaaggtattaaatgaattaaaaaagataaaatatcttgatgtggatgcacctataaatttaattgttgatgcaatacatgaagacgattcaaatgcattgaagaaaaaatttcatcttttgagtgatgaagaaaaaatatcagttaatgcaaaggaaaatttgatttcttggtataaagaaaacattcccattccttttgatgaaaatactgataataacaaggaattaactcagctatatgattcgaatatggctggttacaaagaagttttccttcaatgcatggacagctatcgagaggcatcaatggttaaactgggaaatcttgacaacgcatacgggaacttggattttattatagctaataaatgtattcgacaaaaagcatatgagcaaatatatgataaactgagaaaaattgtttatcagtttcagaacgaagcataccattttaatctattaaaaaatggaagtggcaatttttcagtatgcattttaaaagtatctgaacttaatcaggaatactttttgtcaaaagaggaaaatctccaagggtatactaatgtttcaatatttcaaaatgtctttgatgatattgatgcctcattagagaattttagatgcaaaatatatagaatcgaatatgttgaaccaaaagcaatacctgtttccggtaaaacatttttcaacaacaacgaaaaatagaattcgtattttgaaatttggtaatggagtgtgcgtaatcgctaagcaaaaattattatccgggtattagggtatccctaacgaatgtcttaccgtttggataaccaaatggtctgctcgctaagattatacattttaatcaaataaataaaattaaggcacagcctacggtatttttctccgtaagttgtgcctttttctcatctataaattacttgttcattaacgatttctgttgctcggttgcgaatattattcatctttcgcacccacaacatcatatttcctgctttgagtttttctgtaacttgctccttttcgacaagtgattttactgtctgttcaaataaattctctgcttgacactcgacaccgtcaagataatcatagagcctttcactcgtcagaagattataatatcgcaccttatgcctctgctttaggtattgcttgtgacggtttgcgcatacgcctaaatgtatttcttcttgcttcttggttcttacgcaagggataagataattgccttgctgttcatactgcacattcatggtcagccctcctgataaattattttgaaattctttttctttgcaccgataaactctacaagcacatcatcgactgcatctgtatatctgccctgtgcgattaactcgtttctcaggttatttagtgaattgataattaaactgtattcgttattggtcagtgcaagatggtatttgatagttctcattgcgaatccctccttgactatattctactcgactgatttttaaattgcgaatgtgtggattttcaaagcatagaaaaaagactctgaccttttacagtcaaagtctttctctggtgcgccttgcggcgcacgtttctaatgggtgaaagtccctaatccaccctagtagtgggaaggatacagccgagaccaagggtgtcctgttcatagaaatgattatgattaacgtgaggggaatctgaaggaaggtggaggcaaatctctggtctgacgaacagaaatcacataaggctattattgaggacaagactgccagacaagtcaaagtccaataactactcggaattaatgatagtaaatgtggcagatatatggagagaaagaaacgtgtggtaccaagggaggtctcgtcagcggatggaaacagagtaagaaatccgtcagtaacaacgaatgacgagaagtcagcagaagccatagtaaactgatggttgcaaacatcagcaaagggctgaactttaggagacacaagcaatgaaagtaactgaaagtggatttaataacagacaacttcatatggaagactatctgcaaatggtatctgcggaacagaaagagtatgcagaagtgttagaccaccagaagattattgaaaagagcggtgtcatcacagattattggacggacaatcttctggatttgattttgcgaaaggataacctaaatgcggcttataagaaagtaaaatcaaacaaaggaagcggtggaatcgacggaatgcaggtggatgaacttctgccctacctgagagaaaaccaggaaactttaatccaagaaataagggatggaaagttcaaacccaacccagtccgaagggtagaaatacccaaagaaacaaaaggcgagtttcgcatgcttggagtgccaacagtggttgacagagtaatacaacaggcaatcacacaggaactcacaacaatctatgaggatcaattctcggaaaatagttttggatttcgccccaaaagaggagcgcacgatgccctcagacaatgccaagagaatgtaaacgaaggttacgtatatgtagtggatatggacttggaaaagttctttgacacggtatgccagagcaaactgatagaggtgttgtcacgaaccatcaaggatggcagagttatatcgctgatacacaaatacctgaatgcgggagttatagcaaatgggatatttgaacgtacagaaataggaatgccacaaggtggaccattaagtccgttactaagcaacatcatgctgaatgagttggataaggaactggaacgcagaggacacagatttgtccgatatgcagacgattgcatgattttctgcaaaagtaaaaagagcgcagaaagaaccttgaaaaatatcattccattcatagagggaaaactttttctcaaagtgaacagaaagaaaacgacagtggcacacgtcagcaaagtaaagtaccttggttatagtttttacagaaataagggaaaatgcagatttagagtgcacccgaagtcagttgcaaagatgaagaataaaatcagagaactgacagacagaaataatggcatgagcaatgcaaaaagagaagaaaaatatcaacaattcgtgcgaggttgggtaaattatttcaaactagccgacatgaaaaatcttctcaaagatacagacgaatgggcaagacgcagaatcagagcggtctattggaaacaatggaagaaaatcaagacaaagtaccgaatgctgaaagcattgggaatggatcattggaaagcgaaagaactcgcttgcagtagaaaaggatgttggagaatggcgcaagtgctaaaccaaatcttttcaaacaaaataatagccaagttaggatatatacccatgcttgactattatctggtagtttgtgaaaactaaggaaccgccgtgtacggaaccgtacgcacggtggtgtgagaggtcggctaatcaacaatggttagcctcctactcgatttctttgcaatgccctataaagttgtattcttataatttttaagttactgccttatgtggtgttagcaaaaagtttctcctgttttttttgcaagaataagccaaagtatggtatgatataggcaggtgactaaaaaagagggattgagcgaaaaaaatgaaaaaactatgggattgggtgaaggatgtttgggtatattcaggtctgtcaaaagaaaactatgaaaatatccagcaaagtgtggcgcataaaaatgcaagattgttaaaaaatgcgattcgttcttttgaagtgctcacaggagtattattaattgcagcgttctttttttcacaattaaatgcgttgaagagttttttgattcttacttttatcggtatgatgatgatggaaattatagtacgtgtctgtgatttgaataattttagaacacttcggagtgtctgttatgtatttctaagtacagtttatttatttacagcgatttcgggtacagttggaagtccgaaacagagtgcaacttcatattttattttattgtttgtaggaccgcttttgtttattgacaagccatatcggatggcgttgcttctttgtattatgacggtgatttttcgatctcttgcactgcattataaagagccggagattgcaaattttgatgtatcaaatgcaatctgttatacgatacttgcgattttattatatcttttgaccagtcgtaccaaagcagatgagcataggcttagatgggaaattgctaagcagagagatacggatgagctgacaaagcttttaaccaaaaatgcggtagagagaaagataaaacagtatatggaattaaatccgtccaagccggcaatgatgcttgtaattgatttggataattttaaacatatcaatgacacgttcggacatgtttatggagatgcagtactacgtttgatgggagaatgtattagaagtaatttcagagaagaggattataagggaagatttggcggagacgaatttgtagtatttcttccggatgtagatgataagcagcaggtagtaacttatgtcaacaacctggtagaaatgatgaaaactcgtgtcagaacaccggagagtgcaaatccggtacatggaagtataggaattgcgctgtatccaaaacatgcctctacttatgaagaattgtttaaaaaagcagatgaggcattgtatgcttcaaaagaacggggaaaagaccgctatacattctatatacccaaagaagtattaaaataaaaatcgaaaaggatttggtgagttattatggaagaattatatcaggcaattgaagaaaaaataaaagcttcgggttatccgagagcaatttcaggagcagatgtgtacgatgatatctgtgaccagattgaaggaaaagagaatggaagttatttattattatccaaatttgaggatgatgtaatatttgagtaccatgtgaccattcaggatgaagaatttaatcttgggattttgaccatgcgtactccggaaggaatatttgaagctgattttgataaatagaaagagtggctgtcgagttttcgacagtccttttgttttttcatagcgtttgtcgaaaaaacatagtataataaaaaggaaagctatttttaaccgaggaaaagagggctcaaatgggtgaaattggacagatttttttaaatctgggggaatattccggaccaatattaatcgggctgctggtgggagtttggttgttcgggaggtttctgaaattaaatttaaaagaaaaaagaaaaagaaatcttcaggatgcaagagatattattattctgaaatagaagagggagaatcggaaatccatattatgagccaggtgaagcagatggatgttatcctgtattgcacaggtggcatccattttgtttttgcctgctattactatatatactatatgcgttttgtacctcattgaacctctgggaaagactttgacatctaatcatgggtatgatacactgaacttaactatgggtattgtgtcatggtatggcaaatattaatagtagaaacttaatatacgttatatatttagtacaaacacagcaaaaggaagtatcgaatgtacagctgattttgagcgtacatgaaactaacagaggtgaaaatattggataaaaaggaataccgtgcgagactggatgagattaacaatctggtagagaagcaggattacagagaagctctgaatgttgtagagacgattgagtggagacgggtaagaagtgcaagaactctttgtatggtaagtgaaatctacgaggttaataaacggtatgatgacagtctcagactgcttctgctggcttatcagagagcaccgagcggaaagctgattttatatcgtctggtagagttgtctgtaaagatgacagattatgaaagtgcagttaagtactataatcaatttatgaaactctctccaaatgataacaaccgttatattttgaaatataagatttataaaggaagaaaaaatccgattgaggatcagattaaaatcttagagaaatataaagcaagtgagtatacagaacgctgggcttatgaactggcaagattgtatgcaagagccggcatgtacgataaatgtatcgcagaatgtgacgagatggttctctggttcagcgacggaaagtatgtaaagaaagctctggagctgaaaatgaagtatacggagctgacagatgcggagaaagaaaaatataaggaactttatggagagccgaaagcagtacgtattgcaagaacagcggcaagtgtaagtgcggcaactcaggcggcagcaaagatgctcaatcagactgcgcagactatggtaaaaccagaggaagcagtaaattcagttaaagcagaggcatttcagattccgaaaccggaggcgattaagaaagctgaatctggggcaggctcagaagcaaaagcggaagaggaagtaaaaccggaactggcagaacagccgaaaataatgaagatgccggaatttattaaaactccggaagttaaaccagattttgaaccacttccggaaattcaaatgccggaagaaatcaaaaaagaaatcgaagaagaactcgaaaagaaaaaagaggtagaagcaaaactgcaggaagaaacagcgaaaattgcagaagaagaacctgttaaagaatttgatttagaggcggcacttggagctgcggcagatgagatggttcaggaagaaaaaactgaagcagtagaaaacgaagcggaagcaaaaacagaaatggaagtgtcagaaggcgcaactatccagcttccgttagaagagataaaagcagcacgtcaaaatgcagtagaaaccgatgcaacggttgatttatcaaatgttgtagaagaagcaatggcggaagcggttgtgacagcggaggaagaaacagcagaaaaagcggtagaagctgaaactgaggcatcagaggaagaagtggctgaagctgagacagaagagccacaggaaaatgaagcagctgagtccgttgagacagaagagcagcaggaagagaaagtgacggaatctgctgaaccggaaccgattgaagtagaagaagcacgagagagtgaaccggcacagtggatgcttgaggagccagtggagtcagaagaagaaaatgcagagccggaagcagaagtagctgaagaagtagaaccagaaccggaaaaagtgcttcgtcatcatttgacagaggaagaacacagacgactctttacttattttgcaccaattccgggaatgaaagaacaggtaaaagaagctttggatatcgcacagaaatctgcgtgtgaaaagacttccaaggcaggaaatatgattgtaactggacgttccggttcaggaaaaaccagattttcagaaagcctgattaaagcactttgcaaagaacgccagatggaaggtgcaaaagtggcttacctgaccgcagaggtgttaaataaaaaagaccctgcatttattgtagataaactttcaggaggatttctggcaatcggacgtgcatctgcaatgactgcccaaacagttgagaatctttccaaagcgatggaatttaagaccaatcgtctgactgttattttggaagattcaaaagccggaatttatacattgaagcaggattatccggaatttatggaaaaatttgattcgaggattgtaattccggtttttaccaatgacgagctggtgtcattcgccaagacttatgccaaggaaaaaggctataaggtagatgatattgcagtacttgcggtatattctttgattggcgataatcagtatgaagatgacccagtctgcgtcggacaggtaagggaaatgatggatagtgcaattgcaaaagcttccagactgggtagacgtccaggtaaaaaagtggcaaaacgtcatctggatgtaaccggacgaattatgctgtatgaaaaagactttaacctgtaagatatcataacaggaacagtttgcagataaaaatatagataaaatttgcagataaaaatagagtctgcagataaaaaatatagatgaaaaagcagataaaaaagggagaaaaaaatatggcagtcccatatcttggaaattcaaagaatacgattgaagtattgcagaaatatgattttgtttttcagaagaaattcggacagaactttttaattgactcccatgtacttgataaaattgtaagcgcagcaggaatcacgaaagatgattttgtactggagattggtcccggaattgggactatgacccagtatctggcagcttctgccagaaaagtgtttgcggtggaaatcgataaggcgttaattccaattttggaagataccttaaaagagtttgataatgttcaggttatcaatcaggatatccttaaagtagatatcaaaaaactggcagaggagcacaatgacggaaaaccgattaaagttgtggcaaatctgccatattatattacaacgccgattatcatgggattatttgaaagtcaggttccgattgattcaattaccgtaatggtacaaaaagaagtagcagaccgaatgaaagttggtccgggcacaaaagactacggtgcgctgtcactggctgttcagtattacgctgagccgtatatcgtggcaaatgtacccccaaactgttttatgccaagaccaaaggtaggaagtgcagtgattcgtctgaccagacatgaaaaaccaccggttgaggtggctgacgagaaattgatgttccgcctgattcgtgcttcttttaaccagagaagaaagacccttgcaaatggattgaataattcaccggaattgtcttattccaaagaggaaatccagcagactattgaaaaatgtggatttaaagcgggaattcgaggagaagcactgactttgaaggattttgcaaaacttgccaatgcattttctgaaaagtgaaaaattcaagaaataaaatgaatacagaaaaataaatacagaaataaaacgaaaagccatcgcccagaatatccgaaactgggcgatggcttttttctataaatattaaaggaaggagagccggtcgtttgcgaccgacatatgaaaaagaaaatataaaaataatttttgttctttattatttttatggttttagtatattcgataaatgtgtgcaaatcatgttgaagttgtgaagaaatcatgaacgaaattcaaaacttttgtgaatgacagattttatcgtattttgttggaagaaaaattttcaattatcaagtgacgaatatccagaaaacgttcgacaccaatgcggattccccccatcagaccggaaatatcctgaagccgggaagggataatctggcatttacgattctgatgatggtgcagatagtcctgaatcgagaggttaatctgcggaatataattagaaaacgagctgttgagcacgaccagttcaatattaaacgtattaataatattgttgattgcaattgaaatatatttggaaaataattccatcatttcaagtgcttcaggaacctggttctgatagtcacggacaaaagcatctatcgtaacctgttcctgatgggtgagtctggcatattcttctaaaatcgctttctcagaggcatattgttccagacatccatgattcccgcatgggcagggtttgccgtcgggaaataaaattgtatgtccgatttctccggcatagccgtcctgaccacgataaagatgaccgttaatcataattcccataccaattccatcatgaatatttaataataccatgttttggtcataatgatgaaatgccgattcaccgagaacagacaggttcgattcattttcaacaaaaaccggaatgtgaaactctgattcaagcagtttggccagattagaatccggaagcggataataaggagtaaaaagaatctgattttgttgtacaacaccatagattccgatggtaattcctacgattttatagggacaatccccatactcaggcaggatatcatgaattatccggcacagatttttgtataaattatctcccttttggaacggatattcttttaaacggcagttttctccttttaaatccgaagttaaagcaataatctgagacggatgcacgtcaatagaaagtgcatatccgcattttttctgaaattcaagtaaaataggttttcttccaagagaagtctgagcgcttccgatttctaaaatcagatgctgttcaatcagctcctgaacgatattggaaatggtcgcttttgtcagatgaagctgctgagaaagcgcagcccttgagaccggtggatggtttacaagatattcaagcacctgcctgcggttattgtcgcgtatcatttcctgatttgcaatagccatgaaaaaaatccctcctttaagtgaaatgtactcttgaaaaatcagccgtaaaatcaaatacagaaagattcggagagtacattgcgtgtattatttatcataccacttttcttaagtggcgggcaagaaaatttgtataatgggtaaacaaaacgtaaaggggcagttgaacgcagataagcattctcacacttcaagtgcgcagagcgctaagcagtgggtaaggagtttgcttttggggttgattttgcaaaacgattaggcagaaaaaagtttcggataaaatttcttaatgaaaactttagatgcataaaaacagggagtgtgttatgatgagggtgaaactttgaaaggagatttttattatgaaactcaacaaaagaaaattagcgttactgatgacaggactgatgctggtcatgtctccggtcagtgtatgggccgatagagaagatgcaaaactggagaaaccttatgtatccttaggtgcagacttaagtgcaaatgaccgtgcaatcgtattaaaattgcttggtgtgacagaagatgacttgaaaaattataccgtaacaacgattaccaatgccgatgaacacaaatatctggattcttatctgagtaaaagcgtaatcggaacaagagccctttcttctgtactggtaaaaggaaaaactgacggaagtggaattaaagttacaacctacaacattacttactgtacgaccggtatgtaccagaacgccttggcaacagcaggaattgaggatgcagagattgtggtagctggtccttataatatttccggtacggctgctctggttggagcaattaagtcttatgagaatatgacaggcgaaactgtcagtcaggaaaatgtagacactgcgacaaacgaactggttgtgaccggaaaacttgcagaaagtgtaggtgattccgataaagcagaacagttagtcggagcagtaaaagaacaggttgtagaaggcagtgacaatggaaaaaaactgacggaagaagaaatcggaaatgtagttgaccaggcagcacaagagatggatgtccagctttctgatgaggaccgtcaggaaattgttgctttgatggataaaatcaagggactggatattgatgtggacagcttaaaagaacaggcaaaagatttatatgataaaatcgatgatttaggattaaaattagactggaatcaggaaaaagtacagggattcttctctaaaattatcgaatttttcaaaaatttattcagctaaaaacgaatagaaatagttccatggaacagttatatgggtaaaaaccgggggaagacgtctcaaaaatgtcttccccctttcatgttactcattttctgttgcgctgtatttctgaattgcctcatttagagatagcatacgctggtctaattgagccacaatcgtagcacattcctgtaagtctttactgatgtaatccggtgcatttccctcaaacttgtaataaattttatgttccaggcttgcccagaaatcctgtgcaattgttcgaatttgaacttctacgggaacatagagagtcttatcatagagatagaccggaacagaaaccagtagatgataactttgataaccgctctcttttggctgtttcatatagtcttttatgttctcaatgcgcaaatcattttgcttacgaataaaatcagcaatcagataaatatcagaggtgaaagaacagataatgcggattccggcaatatcgtttacatatcgaatcatgtttggaatatttgattcgtaaccatctttttttaatttttttacaatgctttccggagttttgattctcgattttacgtgttcaatcggattataatgctgaatatactgaaattcgtcgtttaagatatcaattttagttgccacctgttttaatgcggcatgataaagaaacatcatagtttcccagtcattgacatctccatattctctttcaaaaattgaattatttatagtatcacttccttttttgtcgcttctgtatagtatagcataaaagataaaagatgaatagaaagaaaataaaaaagagattttccgaaaaaggttgacagaagagaggggacgttgtttaataaaattattatattaaacgtttaagtaaaaaagaaggtgaaaaaaggaaaatggcgacgattaaagaaatcgcaaaggcatgtcatgtatcagtggctaccgtttccaacatattgaacaaaaagccaggtgcaagtgaaacgacaagggaacttgtactcaaaacagctaaggaaatggactatatgccaaattatgtggcgaaaaatcttaaaacaaagaatacaagaagcataggtgttatagcggaggacatgactattttcagtattccggatattattgacgggattacggaatactgtgaggaagttgattatcagattttacttacgaatttacggctgtataagaagtatcaggatgtgtattatggcagggaagattattttgaaagggtaaaacaggaaataaaaaagcttatggcaaagcaggttgaggggattatttatgtgacagctcatgagagggtgatgcattgtattccggatgacctgccgataccggcagtcatggcttatggatatacggaaagcaaaaaagtgccgtcgattgttgtggatgatgaacatggagcgtatgaggttgtctgtcatctgattcggcatggacacagaagaatcggtgtagttatgggaaaaaaggatagtcttcatgcacaggcacgtcttgtcggataccagaaagcactgcgagacaacgggattgtgtatgatccggaacttgttgcacagggagactggacaagagaaagtggatatagaatggcagatgaactgcttgcacatgatgtgacagcagtcttttgtatgaatgatcttatggcaggcggactttatgaccgactggatgaacttgggaaaaaaataccggaggaactttctgttgtaggatacgatgacagagagttatcaagttattataagccaccgctcacgacaatccgactgccgctgcatgatattggatatcgtgcagcagaagtgatgattgctttgctggaaaaacggattgtaccgcaggaagaagaagtgatttatcagatgccttgtgagatgttaattcgtaagtctgtgcaggactacaaattatagtggtacaagttgtgagaataggatacaagcaatgaaaaaaacagctttttgagactttttttaaaaggttttggaaagctgtttttcgttaaaatatacaaagaaaacaggacttgaaattgataaatattaggattgagagggaaaatgttgtgcagtttgtacatacttaaacgatttaaaaaaattaaaacatgtagaaaagatggaaaacaaagaaaaaatgagataataagaaaaaaaaagagattatagagatattaatcgttaaaaaataaaatttataagctttttattgtgtaaataatgtggtataaataagaaaaacaaacaagagcgttgtacaaaatcaataatgacagacaagattcgggcagattagacaaaaaaaggtcggaaataggaatcaagttcaaaagagcggaacatttaaatgttaaacgtttaattgaaaaatgtcagtatttgtcaaccaggtatcatgcagaagcaggaggcttctgagttgataaaattattaaaggaggacactataatatgaaaaagaaagtgttagcagcattattatgtgcagcaatggtaggaactacattggcaggttgtggttcatcaggcagtgattccggaagtgatgattccgcaaaacaaacaggtaaaaaagaaatggatgtagagggagatgacgttaccactcttaatgtatggacattcattgaaaaccatcaggatttctacacagatatggctgaaaagtggaacgaagaaaatcctgacagaaaagtaaaactggtattatccaacatggcttatgatgatatgcacaacaaactgtctctggctctggaatccggagaaggtgcaccggatgttgttgatatcgagttaggaaaattcccggcatttatgacaggaaacatcggactgaaagacttaacagatgcaattgcaccatacaaagataatgtagtacagtccagacttgacttatattctaaagacggtaaatgctatggacttccaacacatgttggtaccactgttgcattctataatacagaagctttagaagcagcaggaattgattacacaacaatcaaaacatgggatgactttaaagaagccggtatcaaatatcacgatgcaaccggaaaaacatttgcagcagctgaaacaactgcacagtggacactgaacctgatgttagctcagaaaggtggaagctacttaaaagaagatggttctcttgatgtaaacaacgacaagatggttgaagtattacagtgcatgaaagatatgcaggatgcaggtgcacttgctacaatcgctggtggacagcctgataatgaagaagcttatcctctgtttaatgatggagaggttgcagcagcaatcatgccattctggcagacaagccgttacttaagttacatgacagacctttccggtaaagttgcaatcgcagctcctccagtattcggtgacaatgatgccgttaagacaatcggtggtggcggtaccggtactgcagttgtagcatccggtgaaaatgcagaccttgcagcagacgtatttgcattcatcaaactttctgatgaagccaacgtagaagtatggaacgtattaggatttgaccctgtaaatacagaagtttggacacagacagatattacagaaaatccagacaaccagtatgtaaaatacttcaatacaaaaccatttgatacactgttagaagtacaggatggcattggcttattagactgttatacagatgaaaaaatgccttctattaacaatgtatttacgactcagactttaaatgatatctttgaatctggcgtagatgtaaaagaagcacttgatgaagcacaggatactctggaaaacgaattcgcagaataatcatttgtaagtgataagaaatgtaatataagaagagcgggatgtggggaaatcccatgtcccgctcttattagagagaggagtatatatcatgaacaaggtaaaaaaattcttttactcacagaaagccgctccttatgtatttattcttccatttgtattgacaattcttttattctggattgtaccgattgcaaatggtgtacttcttagttttcaggatgtactcaaagataaatgggtaggctttaataactattcgagattgatttcagataagatgttctacaaagcaatttacaacagcgtaaaatacatgattggaactttgattttactgattccatttccaatgttatttgcaagtctgttaaacagtaagctgatgaaaggtgcaaatttcttcaaatctgtttacttccttccggctttaacatctgttgtagttgcaggtactattttccgtctgatgtttggtgaaatggacaccgcactggcaaaccagattatcggtctctttggacattcaccaatcaaatggttaaaaggtgagtggaccagttactttgcactcctcttggttgcatgttggagatggacgggtgtaaatattctttacttccttgcaggtctccagaatatttcaactgatatttatgaagcagcatctatcgatggtgcaacaaagtggcagcagtttattaaaatttcattcccattattaaaaccaacaaccgtttatgtgttaacaatcagtatctatgcaggtttgtctatgttccttgagtccttcatgttatggaaaggaaataactcaccaagaaacatcggtcttactattgtaggatatctgtacagacagggtattgaaaagagagcaatgggatatgcgtgtgcagttggtcttgtactgttaatcatcgttatgattatcaatatgattcagcttgttgcaacaggaacattcaagaaggaggagagataatatggcagcagaagcaattggaaaaagccagaaaacaaaaaacagagtggcaaccgtgcttatggtaattttctttacgattcttgccatcttgattatcctgccgatttatgccattattctggcaagttttaaaccgggtaatcatcttcttcagtatggtttgaaccttgatttagacagtgcaagcatgacactttcaaactacgtgttactgtttaccggtcaacatgactactggatttggtttagaaacagtttattcttaactgttgttactgtagtattaaccttactggtaagtgctttcgtagcttatggttttgcagcttatgatttcaaagggaagaatttcttcttcgtattagtattgattattctttctattccttttgaagttatcatgcttcctttatacaaacagatgtcaacatggggactgatggacagctatgtagcagttgtactgccattccttgcacatgcgtcaacgattttcttcttcagacagtacctgcttggtacaccaaaatctctgattgaagcaggtcgtattgatggagcaactgaatacggaatcttcttccgtctgattgtaccgattttgaaaccggcattttccgctatggcaattttaaatggtatgaatgcatggaataactacatgtggccattactggttgtgcgttcttccagcaaatatacgttaacaatcggtttgaacacactgattaacccttatggagataactacagcctgttagtagtaggttctgtattctccattatcccaatctttattctgttcttatgcttccagagatacttcatcgaaggtatgactgccggagctgtaaaggaataaatacttaaaatatttacataattatgattttgaattttcaggaggattaaaaaatgagcagaagagcgaaaatggttctggataaagagttccagattgcaccaattgataagagaatttatggttcttttattgagcatttaggaagagctgtatatgagggaatctatcagccaggtcatccggcagcagatgaaaatggatttcgtaaagatgttatcgagttggtaaaagaactggatgttccgattattcgttacccgggcggaaattttgtatctaatttttactgggaagattctgtaggtcctgttgaggaaagaccacatagactggaacttgcatggagaagtcttgagaaaaatgaaattggtctgaatgaattttcaaaatgggcagaaaaagtgaattctgatgttatgatggcagtcaatcttggtacaaggggaatttcagatgcctgtaatcttctggaatactgcaatcatccatcaggaacaaaatacagtgatatgcgaattaagcacggagtaaaagacccacacaacattaaagtatggtgccttggaaatgaaatggatggtccatggcagattggacataaaacaatggaagaatatggacgtcttgcagcagaaaccgcaaaagcaatgcgcctgattgacccaagtatcgaactggtatcctgcggaagttctttccgtgacatgccgactttcccagactgggaagcaacgactctgtcccatacttatgagtatgtagattatgtttccatgcatcagtactatggaaacagagacgatgacagcaatgattatctggcacagtctgatgatatggatgatttcatccgtacggttatctcaacctgtgactatgtaaaagcgaaaaaacgtagtaaaaaagtgatgaacttaagctttgatgaatggaatgtatggttccattcaaatgcagctgatgatgatatcacagaaaatcatccatggcaggtagcaccgccaatgctggaagatatctacaactttgaagatgcactgttagtcggtttaatgctgattactcttatcaaacacgcagaccgtgtaaaaatggcgtgtctggcacagttagtcaatgtaatcgctccgattatgaccgatgcagcaggtggcgcatggaaacagaccatcttctatccatttatgcatgcttccaaatacggacgtggcgttgcactgcttccggttatgaacagcacaaaacatgcaactgcaaaacatgatgaaatcacagacgttgaatctgttgcagtttacaacgaagaaaaagatgaagtaacaatctttgcagtaaaccgtaacttagaagaagacgtagaacttacaacagatgtaagaagctttgaaggctaccgcatattagaacacatcgttatggaaaacgaagatctgaaagcaggcaacagcctggccggagaaaaagtttatcctgtaaatggcgatgagagaagcaaacttgacggcggagtgctgacaagcgtaatcaaaaaagcatcctggaatgtgattcgtctgggtaaataaaaaataaaagaagtaaatgaagaacgaattgtcgtattaatgtttgagaaaaatgttaatgcgatgattcgttttttgatttaaatgaaaaaaattatgaaacaaataactgtgatatacctacagaggcgagatgaattgttcaataattgggattgtgatataatgaaattgataaattagtgggagtttgtagtcagatacttttggaactgtgaatgaggcaaagtattagaaaattgaagattgtggagggtttattatgagtgagagagcagaaattacttttatgcagacaagattaatccgacttgcttcagaagaatggcatttaccgattgaacagattatttacttgttcaaaaaagtagatgttcttggatatatagaaaaaggttatgggattttccattgcgaaggtgatgaggcggtactggaagatattacggagcttcttgaaggaaaggggataaaagttaatgcttgaagtaaaagatggacttgttctctatcatggaagttattgtgaagtaaaagaaccagaccttgccaaatgtgcgaaaagaaaagattttggccggggattttatttaactacatccaaggaacaggcagaaaattttttaagaacttcaataaccaaggcaatagcaggcggaagaattgaagagggacagaattatggctatatttcgacttttgaagtaaaactttcgggaaaacttgagacacatatttttaaaaatgcggatgttgactggttacactgcgttgcagctcatagaaagaaaaaaatgttcatcgaagttgaacaggaaatgacaaaatatgatattattgcaggaaagattgcggatgatgcaacaaatgccaccctcacggcataccttgctggtgcttttggaatggcaggtgataaggaatcagatgatttctgtattaaacggttgttgccgaataaattaaaaaatcaatattgttttaaaacaaaagcagctattgagtgtttgaaatttgtggagagtgaaaagatatgtctgaagtaacaatatcaaaagaaaggataaactatacaatagaccttcttattactatggtaacggaagaaattgcagaagagacgggcagggatagaaaagaagtgctgatggattttctatgttccagaacaggaaaggcattatacgacgagaaaacaaagctttggtgcaatggaccatcgtatatagctgaagtgtatatggaggaattaaagcaaagagagattgataaatgagaagataaaaaacgaattgtcgtattaatgtttgagaaaagtgttaatgcgatgattcgttttttgttttaaatgaaataaataattgttgtatgaattaaggagagagacaaattgttctatcattgggattataacatgtaacgggaagaaagatggttattatttgccatcttttttctcgttctgataaaatttaggaggggtgactcgaaatggatcacaccctcctcttagttggaactatctattttccgacagacaatcatgagaaaatctcaccacaataaatgaaaactggatactagctatacgttatgtagtggtatacttaaggtgccgaataagatcggaaggggattggtgcttacaagcccgtccgacagactgattttcagctccttaggtgtaccactttttgtttccatcgggttttgatgaggacgcaggacagccaacaattaagcaaggagctgcatcggcttatgcgaaggaggtttgctttatggaagtattgtataagcggtgttgtgggattgacattcataaaaatatgatggtagcctgtatttttacgagtgtcagaaaaaaagaaatccgtcagttttcaacaatgacggaagatattctccaattagtttcgtggctgaaagaaacagattgtgagatggctgccatggaaagtacgggctcttattggaaacctgtatataacatattcgaagaagaacagataccgatcatggttgtgaatgcgcagcatatcaaaggagttcccggacgtaagacggatgtaaaagatgcagagtggattgccgatctggtacgccatggattagtaaaggcaagttacataccaaatagggattaaagagaactgcgagaaataacccgttaccgccaggaggtaattgaagaacgtgctcgtgaattaaatcgaatccaagctgtgttagaaggctgcaatattaaactgagcagtgtaattaccgatatcagcggaaaaagcggtatggcaattttaaaggcaattgtatctggagaaacagatccggttgttttaagtgaacttgccgaaggaagagccagagataaaattccagaaatgcagaaatccctacaaggacggatatcagaacatcaacaaaaaatgttgaaacatcaactggggcatattgaaagcctgaccgctttaattgtggatttagatgcagatattaaaaaaaaacagaatccataaactgggcaatcgaagctttggatgatatgcctgggattggaagaaaaagtgcagaacgaattttagcggaaactggtgtggaaatggagcactttcaaaatgaatcccgtttcagctcatgggcgggacttgtgcctgagtgtaaggaaagcgccggaaaaaagatgagtacacgaatacggaaaggaaataaatatttgaaagcaacgctggtggaatgtgctcgtgctggaatacgaaacaagcaaagttatctctactcccgttatcaaagaattgccgcgcgcagaggtgggaaaagggctttgattgcagtagcccataccatgttaatcgcgatctatcatatactaaaagagaaagttccttatcatgaccttggagcggattactactccgttatcaatcaagaaaagataatcaataggaatattcgtacattagaaaagttaggggtaaatgtaatgattcagccgaaatgaatctctttaactgtataattaagagaaggaaataagcccgccaaaaggcgagcttatttagaatgcttgtttatagattatcgctgaactacgttttcaggacagccacttttttgtgaattgtagaaattagaaaagattaatgaggacattttgtatatgtataagttgaaatcaaatttcctaatactaaattctggcaggaagaacatctttgcgcttgatattttagaaccttgcaactgccgttggtctttttatcatgtctggtataagttccacttacataggtatgcttacataattttttttctgatatggctacatctggtatggccacattataagaagttccattttcatctgtgaaataagaattagaaaaaagaaaagtatcctcctctttatcaacaactgagaagaagccttccgttccagatatatttttatctttattaagaacttcttctaaggagtgaatattatctatttctacagcgggtgtattataagcaagaatggtaagggaagaagaaatacttaagaatataattccgaatccagttacaatagaagtaaaaatagggtgcttatgtacagtatgttttttcaaatgagtaatcctctctttcagtgtattttttcgatgaaacgtaaatccacttgaagaaacaagtgaaagatgcggtggtgtagatgaatattttaaaaggaccttgccatagtttcttttttgttcgagtgtacaattcattaacgctaaatcatcagcggctaattctgaagtattttgataaaattgaattaaaagataaatacatgggttataccaaaacaaaacagataaaagcataagagttagcttaaataaattatcatggtgttttagatgtgcaagttcatgtttaataatcaaatggtttgtatcatcagacaaattaaaagataaaggtaaaaatagtttcgtgttcaaaaatcctgtcacaaaaggaattgaaatgtggtcggataatgagagaattggagatttagataatctcaaatccctcgataagtttgtaatgatagcttggtttggctgaatgaattctttaaaattaaaatcggaagcaatagttgagcagaaacttttagtttgaagatataatcggcgtatgtaaatagctctaaacagcataatgctaatgcataaaaacagtccgattaaaattccaatactgatattcggtggacgaagaaccagatgattttgaacaattctgattgaatcatcaacaggtattttatctgttggttttggatgcatcataaatggagaaaacaatcgtttgtaataatttgtaagtaaaggaacaggaagtaaaaataagaagatatttactttacaaaataaaagtttatgcttgggcgcaagctgtttattaaataaatgcgttgcgccaatagataaaaataaaaagacacttccgataagattcatataaaaaagtaagcgaatggaagaagcaattattaaatttatcataaaaaaatcacatcctaatctttattgagaaaatctcttagttcatccagctcttcttgtgtacaatcttttttgttgcctgtaagggcagaaagaaacaagttcaaagaaccattaaatgcattgtttaaaaaagattttgcatatctttgagtgagctgttcacgtgtcaattttggaaaataagcttttttacgtccttcatttttacagtctaatgcacccttttcaattagacgtgaaagatgagtgtgtaatgtttgctttttccagtcttttccattgttattaaagaaatccaaaatttgattgaaataaatggggcatttagaagaccatatcatttccatgatttccaattctgtgtcagataaaccgtatcgatttggcataaaaacctccttatgaatgtagtactattttaaaatagtactataaaaatgtggggaggtcaagaagaaataataaacaaataattaataaataattaataaataattaataaaagtattgacgaatactatatttatatagtacaattgtattataaagatataggacgtagcttgagcaatggtgaaaatgtaaagtagagtattatcaaagtaaaaaggaatgtgtagtataaaaatctaatatttactagtaagttttagctaatagaagactttgtctttgtaacagtttattggcataataatattataaattttcagaatattattagagttgctggctttttttaaaaaaatgaaggcttaagagacaaaggcaaactcaggaaagtaatagttcgtgattgaaaaaatgaaaggaatgaaaaaatgaagaagataataaataaagttattgtgttcacattgatttttaatatcagtattattattaatgctatatctattcgagcagcaggtgatgatgataaaaaagtatatacggaattagatgaaaatgtgaggaacatacaagatagtaaagatgcctgtattggtgtggagggcgaaacagagccaaatgaaatgattgagtatagtagagcaactacaaaaccaggtaaatggattaaggcatctgatggacgttggtggtataagcataacgatggaacttatactaaaaatggatgggaatatatagatggaaaatggtactattttgatagtaacggttggatgaagacaggatggattaaagtaaataataagtggtattatttaaatagtagtggagcaatggttgtaggatggcaaaagataggaagtacatggtattattttaattcctcgggagttatgcaaactgggtggaaaaaaataaataatagatggtattttttagaatctaatggagcaatgagaacagcagctttaacacagggcggttcaaactatacatttcagagttcgggagcattaaatacaactaggctgggagttcaaaggcaaaggcaggaacgaactaattggtgctgggcagcttcttgtgttatggtcggaagatatgatttgccggcatcattacaaacaataacacaaacatcagttgttttacatgtaaaaggagaaattattaatcttgcaggaaatggctcagaagaagtgagaggaataaatcatgcttctcaaagtttaaagcatgcaacatctttagaaagaactctctcttttactgaggtacttaatactattgataatagacatccgtttattgtaagaatgagatgggatggtggcggtggtcatgcagttgtatgtgctggttatagatattctgattcttcattataccttatagatccgtgggaaaatacagcgtcgaggtattattcacgtaatagtctggtaagaggtacttctattgctactggtacaggtcaatatagattttcggtaatatattaaaaggatgataagaaagaagggcgtagttatgaaaaaatttttgataatagcagtatttactttctcaattatatttttaaattcctctaatacatacgcttactcaatcgaaacactagacagtaatccagatttacacgaaatttcccaaatggaagacgagatttaccgttgggcgcaaggcgcagtagaagatgaaaatacgaatttacaaatcgattattctcgagcagtgaaaatatatatagatacaaatatttttgaacaagaagaactgacggctgaaaatttacaagatactttagataatgcggtttatatttgggaagttcctgtaaaagtttcagaagacagatatgtgattgtaactgtaagcagggcactgccaattgatgaagaattgcagcaggagcttcttgaagatggcacttatacacaggaagaactggaaatggaacttgaaaaagtaggtagttggacaattccaacagccggatatgatgaaacaaaatcagactatattggaaagttagattctgttttgggagaaactcttaataaagaggatttagatatgatataccttcttggtggaactccgaagatgagacagccttttggtgttgtttgtagagaaggcaaatatcagattgttacattagatgtggtaaccggagaaaatgatataagtgcttttagttcagaagaaagtcaggaactgaatgagaatagtatttatagttttgaacaggtgaaagaagtaatagagtcaatgccagaagtggatgacgaatcagatacagggctagctccaacattaaaaaaagaaaatatgaaaaaagaaaatgctaaaaaggaaaggatatatggtgttgtagttttactggtaacagttttgctggttggcgtagctttgggtaaaaaattgaaacggaaaaaataaatttagagaaagaaggggtgtcgggaaatatctatttcccgacacccctttctttttctaagttagtcaagcggatattcgtattttgattcgctacttccttgattcggttaaattattaattacatcggaagagccatatccccatctttaatccagcctaaatttctcatcatatttgagaagaaataggtcagtgcagccggaagagcaaagtgcataattaaaattttaaataataccactacgcttgaaactcccggaacagccatggtctgccaggtcataatctgtccgacaagtcctgctgttcccattccggaaccggttgcattgtttgtcattttaaagagaagtgtagaaaccggtcctaagatggcactcgataaaatgacaggaagccagatgagtggtttcctcataatattaggaacttgaagcatggaagttccaagcccctgtgcgatcagaccaggagctccattttctttataacttgcaattccaaaaccgaccatgttacaacagcatccgacggttgctgcaccggcggcaagcccggatagatttagaataattccaagggctgcggaactaatcggaagagttaaaatcatacccattaaaacagagacgataacgcccattaagagaggctgttgttcggttccccagttaattaattctcctaattcagtcattaacttgctgattggaggaccaaagaaaagaccgatagccgaaccggttaaaattccggttaaaggggtaataataatgtcaagttgggttttgccggagacaacatgagcaacttcaattgcaatataagcagcaagaaaagcgccaagcggttctccgggaccggaaagtaacagtgcaccatcctccgtgaaaatcgttccggcaaggattttgcttgaataaccgccaaccataccggcagttgcagaagagagtacaaccagaggactttcgccaaatttgcaggcaacaccgatgccgataccggcgctggtcataccggcagctattttaccaaactgatagaggtaagtgccaatttcaccactgattaaagtaccaatctgttgaagaattgttccgataataagagtggcgaacagaccgtaagacataccggtgagtccatcgataaaaaatcggtttaatattttttttaccatgatatctcctgtattctattttacttaatctaatttaatatttttaaaaagagagccgagtgttgtagtagcttcttctgcttccggaagttcatagtcgatgacttcttcctcttcttcttccggagcttctattaaagctttcatgctgagactcagttttccatcttcatttttgataacttttacggttacgttatcgccaacagagaggactgcttttggagatttgattcgtttctggctgatctgtgagatgtgaaccagaccggaaatgccatctccgaggtcaataaatgcaccgtaagtctgaaggctttctacggtaccttctaatacgcttccaacagtaatctgctgtgtttttgcaagtttttcggcgtcagcctgctcttttaataattctcttgcggaaaggacaagacggttttctgcttcatccacttcaaatacacgtaccatcaaagttttctttaaaaattcttccggttctttgacatattccagagaaagtttggaaaccggaataaaggcacggatgccttccacgtaagcgattgctccgccttttacgatgccttcaatagtaacttcaaatgcttctttatcttctttcatctgttctaacttgtcccagatttccatgtctgcgtcacggaaattgctgaaagaagcttcgatttcctgtgcaaaatcatccattgtttcctgtttttttatttcttcgctcatgatgctacctccattaatacttccttaaataaaattgaaaaataggaagctttttgttttcgattatagcacaggaaagtgaaaatctgcaatggagtagagagaatgttgaaagatttgttgattttgtcgggtgggttaaggtaagataagaaagactaaaaaccgatgtagatagttctgacaaaaagccagaatagaaagagagaaagaccgatggaaatcagaaaagcaaaaatagaagaactcgatgaaattatggaaatttttgaacatgcacgtcagtttatggcgaagaacggaaatgcgtcccagtggggaacaacttatccggaacaggaaatcgtagaagcagatatcaaaaaagaagagtgttatgtgtgtgtcgaaaatggtgaaatcgaggcaacgtttgtattttttatgggaaaagtagaaccaaattatgtggatatttatgacggagagtggaaaaatgaagctccttatggtacaatccaccgcgtagcaagtcgcggaagagttccgggaatctcaaaaatctgtatggatttctgcaaatcacagatttcgaatctgcgtggagatacttataaggataatattgtaatgcagaaagtatttgccaaaaatggatttgaaaaatgcggtacgatttatcttgctggaaaaaaagaagatggaaacgcacgaattgcctatcagtttgtgggtaaataattgcacgcagaagaaaaatgggatattatatagagtagaagaaaaatttgaaatagaaaagaatttggaatgtaaatataagaaagggaagcacacaacatggcgaaacaagaaaaaatctatattttaggacataaaaatccagataccgattcgatttgttcagcgattgcttatgcagatattaaaaatcgttcgaatgatggaagaaagtatattgcaaaacgtgcaggtcagataaatgaagaaacagagtatgttttaaaacgttttggcgttgatgcaccaggctatcttccggatgtcggaactcaggtaagagatatggaaattagggaaactccgggagttccgcacagcatttccattaaggatgcatgggcgattatgaaagaaaccaatgcggtgacacttcctattacaaaagaggacggacagttagagggactgattacaaccggagatattgcaaaatcttatatggatgcgcatgataattatttcctttccaatgcgagaacccagtatcgaagtattgcgaatacagtagaaggaaagattgtaaccggaaacggacatggatatttcttaagaggaaaagttgtaatcggtgcgacacttccggaaaaactgggagagtacttagaagaagatgatttggttatcttaggagatagatacgaagaccatttatgtgcgattgaagaaaatgtaagctgtattattgtgtgtaacaatgcggaagttgcagaggatattcaggaagcagcaacgaaaaatgactgtgtaattatccgttctccgcttgatacctttacgattgcgcgtctgattaatcagagtattccggtcaaacacatcatgaaaaaagataatctgattaccttccagaccgatgattttacagaccagattaaagaggtgatggtaaagaaccgtcacagagccttccctgtagtaaataaacatggaaaatatattggaacggtttccagacgaaatttgctgggaatgaagaaaaaagaagtgattttagtagaccataatgaacgttcccaggcagttgataatattgaggcagcggagattctggaaattattgaccatcacagaatcggctctatcgaaaccatgtctccgattgtctttcgtaatcagccggtgggctgtactgcgacgattatgcatcagatgtatgtggaacgaaatctcgaagtttctccggcaatcgcaggacttttatgcgcagcgattatttccgatacgctgatgtttcgttcgccgacctgtacacacagagataagatggcagcaggagcacttgctttagtagccggtattaacatagaagaatttgccaaagaaatgtttacggcaggaagcaatttaaagggaaagacaacagagggaatcttctatcaggatttcaaacgttttacaaccgaacaggtaaactttggcgtaggacaaatcagttctatgaatcaggatgaactgttaagcttaaagaaacgtctgattccatttatgaaaaaagaatgtggaaaaaatggaattacgatggtatttattatgcttacgaatattttggaggaaacatcagaaattatctgttatggagatggaagtggcagattggttgaggatgcctttaatgtaaaagaagaaaatggcggatatattcttccgggagtcgtatcaagaaagaagcagttaattccggaatttatcactgccttacagcagaatagctaaaagagaaaatctcgaagaaatgaaaaacagaagaaggggaaacacatgggaaaaattgaatggaagcctggaaacatgctttatcctctgccggttgtaatggtcacggtggcagatgaagcagggaatgataacattatcacggtagcatgggcgggaacggtctgcaccaaccctcctatggtatcaatttcggtaagaccggagcggtattcttatacaatgctatgtgacacaaaggaatttgtcatcaatctgacaaccgaaaaactggttcgcgcaacggactattgtggtgtaaaatcaggaagagaggtagataaatttaaagaaacaggactcaccagagaaaaagcatctcatgtgggtgttccgatgattaaggaatctccggtctgcattgaatgcagggtcagggaaatcaaagaactgggaagccacagcacatttgttgccgatgtgcttgcagtccatgtagatgataaatatatggatgaaaaaggaaaatttgatttagcacttgccaatccgattgtatattctcatggggaatattatggactgggcaaaaaactgggaacttttggatacagcataagaaaacagagaaagaagagacagaagaaatgagtaaagaaaatatcgttttaattggcatgcctggagttggcaaaagtacagtaggtgttattttggcaaaagtattgggatatcagtttattgatgcggatttagtaattcagaaaagagaaaaccgcctgttgcatgaaattatttcagaagaaggtttggatggctttttaaaagcagaagaaaatgcaaatgtatacattgcgcaaaatgaagaaaaatcgattgttgcgacaggtggaagtgttgtgtattgtgaaaaagcgatgcaggagttgaaaaaaacaggacgagttatatacttggagttggaatatgaccagctgaaaaagagactgggaaatttaaaaggtcgtggtgtggtattaaaagatggtcaggatttaagagggttatatgaagaaagaattccgctgtatgagaaatatgcggatttgacagttaatgaaaaaaatctggatgtagaacagactttacagaaaatagttgacagactttcattataactgacaaaatgaggaattgcaagcagtaaatctaggcaaaagacgattttttgtttacaaacccggtaagatgttataagataagggttgactattatgaaactttgaaaatcaggttatgaatttgatgataagaatgacaaaaacaggcatcagatacatgaataaaaatatagaggtgtgtatatggaacaatatgtaatcaaaggcggtaacccgctcgttggtgaagttgaaatcggtggagcaaaaaatgcagcacttgcgattctggcagcggcaattatgacagatgaaatggtttatattgaaaaccttccggatgtaagagatatcaatgtattactcgaagcaattaaagaaatcggagcagttgtagaaagagtcagtccgacagaagtaaaaatcacaggttctactatttctgatatcagtgttgagtatgaatacatcaagaaaatcagagcatcttattacttattaggagcactgctcggaaaatataaatccgcagaagttccacttccgggcggatgtaatatcggaagtcgtccgattgaccagcatttaaaaggattccgtgcactgggtgcatccgtagatattcttcacggtgcagtcgttgcaaaagcagagaacttgacaggaaaacatattttcctggatatggtatctgtaggtgctacaatcaatatcatgatggcagctgcaatggcaaccggaaataccattattgaaaatgcagcaagagagccgcatgttgtcgatgtggcaaacttcttaaacagcatgggagcaagtatcaagggtgcaggtaccgatgtaatccgtattcagggtgtagaaaagttacatggaacaacttattccattattccggatcagattgaagccggaacatttatgtgcgcagccgcagcgaccagaggcgatattatggtaaaaaatgtaattccgaaacatctggaagcaacaactgcaaaattagaagaaatcggatgtcaggtagaagaatttgatgatgcggtgcgtgtagtggcaaacaaacgtctgactcgtactcatgtaaagactatgccatatccgggttatccaaccgatatgcagcctcagtttgcagtcgcacttactttggcagaaggaacaagtattgtaacagaatctatctttgaaaatcgttttaaatatgcggacgagctttctcgtatgggtgccaatatcaaagtagaaggaaatacagcaatcattgatggcgtggaaaaactgacaggcgcaagagtcagcgcaccagaccttcgtgcaggtgcagcacttgtaattgccggtcttgcggcagaaggattcacagtcgtagatgatattgtttatatccagagaggatatgagcgatttgaagataaattaagaagccttggtgctgagattgaacgagtatccagtgaaaaggaaattcagaaatttcagcttagaatcggctgaaaaccagtaaaatagcattaaaaataaaaaaaacggtttggaataaaatccaaatcgttttttccttgacaatgtttagcacctgtgctatggtaagtgcgtgtatagatttcatatcaacttattaagtgcatcacagacattttcccctctttttttgtccgtggtgaaaagggaatcaggtgaaaatcctgagcggtccggccactgtaagcaaggagcgaagcgcaagaatccattgtattagagcgtacgagaaggagcgccaagcgttgataggcaagtcaggaaacctgcttaagtaagtgaaaggttgaaacttccgaagaaagttttccatccatgatatctgatatggaacgccttatgcttgaaaaagcacgtatcagaagaacggtacattctgatacaaacttagaggaacctgtgtacggaatttatacatcctttactttgaaagggcaggagaattccaaaagctgtattcgtacataaaacctccgcaaaaaatatgtatgattggtcaatacaggtggaggaattcctcctgcaaaaagttaaaatggacaataaaaacaaagctgttatagataatagtatcttatctgtaacggctttttttggtataatagaaaaagttagtaaaggtatttgaaaggggaaatttaagatgaaaaaaatagaaatggaaaaacaggcaaaagcatttggatttgcaacaatgaaatttatggaaacaaaagatctggagtttgaacatgaatttcgacagttttgtgagatgaatgactgtgggaattatggaaataattatgcctgtccaccgctttgcggaacaccggaggaaatggagcaaaaggtaagaaaatacgaacatgcgttggtttttcagtcaagaactccggttcaaaatatttttgatgatgcagaaacaaaaattattaagaagatgcatacaaataaaacattacatgccgtagaagaattgaaagagcagggtctgcctgataatggaatgtttattatgtgcggaccatgtaatttctgtgaggaatgtaaagcaaaagcaaaagaaccatgtgtcaatgaaacgatgcgtttttcgtgtctttctgcttactgcattgatgcaggaaagatggcaaagcattgtaatatgaatatggaatggaacggagatgtggtttcgttttttagtctatatgttttttaagagaataggacagggtgtatgagacaagagcttaatttaacgcagacgcagaaactatcagaaaagatgattcagtcacatccgctcagtgaccagaaaattgcagagaagatgcaggaaaaaggaatcagcatttcaagaagaacggttgcgaaatatcggggtcagatgggaatcgcagatgccggaggtagaaaagtgtatttgtaagaaaatataaggagatattttagtaaaaataaggaaaatcggaaaaataccttgcttttttaaaaataacgtgtataatacaccatgaaactataaaaaaatcaaatagtggttatcccttttattcagagtgatggaggtacataggacctgtgaagtcacggcaaccccttgaaaaaggaaggtgccagcctgagcgagtaagtcgaacaataagaggattcatttaaaaacttatgggtccgcttgtctgcggacctttttacttgcatgtaaatgggaataagaaacaaaaaatcaaacaaaggagaacaagaagaatggaaaaaagattatttacttccgagtccgtaacagaaggacatccagacaagatgtgtgatgcgatttccgatgcaattctggatgcattaatggaacaagacccaatgagccgtgttgcatgcgaaacatgcacaacaaccggtgttgttatggttatgggtgaaattacaacaaaagcttatgtagatattccgaaaatcgtaagagaaacggttcgtgaaatcggatatacaagagcaaaatatggttttgatgcagatacctgcggtgttatcacaacaattgatgagcagtctgctgatattgcgatgggtgttgataaagcgctggaagcaaaagaaaacaccatgtctgatgaagaaatcgatgcaatcggtgctggtgaccagggtatgatgttcggttttgcaagtgatgaaacagaagaatatatgccatatccaattgctctggctcacaaactgtctcgtcagcttacaaaagttcgtaaagatggaactttaacttatttaagaccggatggaaaaacacaggttactgtagaatatgatgaaaatgacaagccaatgcgtctcgatgcggttgtattatctacacagcatgacccggaagtaacacaggaacagattcatgaagatatcaaaaaatatgtatttgacccgattcttccggcagaaatggtagatgaaaatacaaaattcttcatcaacccgacaggacgtttcgtaatcggtggacctcacggagacagtggtttgacaggacgtaagattatcgtagatacttacggtggatatgctcgtcacggcggtggagctttctccggaaaagactgtacaaaagtagaccgttctgcagcttatgcagcacgttacgttgcaaaaaatatggtagcagcaggtcttgcaaagaaatgtgaaattcagctttcttatgcgatcggtgttgcacatccaacttctatccaggttgacacttttggaacaggaaaactttccgaccagagactgacagaaatcgttcgtgaaaacttcgacttaagaccggcaggaattatcaaaatgcttaacttacgtcgtccgatttacaaacagacagccgcttacggacatttcggaagaaatgacttaaatctgccatgggaagcactggataaagtagaagaactgaaaaaatatctggaagattaataaaagaaatttctaagattcactaaaaaaagtggagaatagataagaataacagggagttttttgtagaaatatgaaaaatttcctgtttttttgtgatataatatgatgtaagtgtcaaaagtataaattgcggttgtgcttgcacaaaaagcaatttatagaaagtttagacttgttttattaatattttcaagaaagagaagaggtttatgttataattatcgttataaaaattttatcttaagttttggaatgggataaacactaaaaaaacaggcaggaaaggagaaaaaggagcaatgaaacttaaaacaagaatcgttatctccttttttgttattatcctcgaaccgctaatctgcgcaagtgttgcattttgggcattcagccagcatcagttaaatgtgatggaagaacaatatggaattgaaaatgcctcttatgattcactttctaatacggcagaagtgattaacagcatgaccgatgacattgcagaagagctgagggagacggcaaaaaaagatacgaaagaattagagaatgaagattatttaaatcgaatcaatggcagattaaaggaagtacattcctatctcttagtaagagaaggaaaccaaattatctattatggaaatgaaaattattcaagtgaacttgtgaaacggctgcctccttatgcctcaattgaagatgagaactccgaagaagccattgatgcacaggataatgatggactttatctgggaggaacagtacaggcactggtgaaacagattaattttgaaaaaccagatggaacacagggcagtgtctttattgtgtcaagtattttaaaaactctgccgcagttaaaggcactgataaaaaatatgatgatttctgtagtggtgattttgattcttaccggtcttggactgacctggtggatttaccgtggagtcattgcaccgcttgataaactgcgtacagcgacacagaagattaaagatggagaccttgatttttcgattacaccggaaggtgtgagtgaaatttcggacttgtgtcaggattttgaagaaatgcgtcagcgtttaaaagagacatccgaagagaaagttcagttcgataaagaaagcaaagagttaatcagcaacatttcccatgatctgaagacgccgattacagcaattaaaggctatgtggagggaatcatggatggtgttgccaatacaccggaaaaaatggataaatatatccatacgatttataataaggcaaacgatatggatcgtctgattaatcagcttacattttatacaaagatggacactaaccgaattccatatacatttaacaagatttccgtaaccgaattttttaatgactgtgcagaagaaattggaatggaacttgaatcaaaaggggtagagtttaactattcaaactatgtaggaccagaggtgctagttattgcggatgcagaacagattaagcgagtgattaataatattaccagcaattctttgaaatatatggacagcaccagagcacgccgaattaatttaagagtaaaagatgtcggagattttattcaggtagaaatcgaagataacggaaaaggaatctcagcaaaagatttaccaaatatctttgaacggttctaccgaacagatgcgtcaagaaattcttctaaaggcggaagtggaatcggtctttcaattgtaaagaaaattatggaggatcatggaggaaaagtctgggcaaccagcaaggaaaatattggtacagtcatgtactttgttttaagaaaataccaggaggtttatcagtaaatgagtaaaattttaattattgaagatgaagaggcaattgctgatttagagaaggattatctggagttgagcggatttgaagtggaaatcgaaaaccgcggagatgtcggattaaaaaaggcattagagggagagtatgatttatttatccttgatttaatgcttccggaagtagatggatttgaaatctgccgtgaaatccgaaatgtgaaaaacacaccgattatcatggtttctgcaaagaaagatgatattgataaaatccgtggtcttggacttggtgcagatgattatatgacaaaaccgtttagcccgagtgagctggttgcaagggtaaaagcccatctggctcgttatgaacgcctgattggaaccggggtacaggaaaatgatatcatcgagatccgcggcttaaagattgataagacagcaagacgtgtctggattaatggagaagagaagaattttacaaccaaagaatttgatttattaaccttccttgcacagaatccaaaccgtgtctttacaaaagacgaactctttaaagaaatctgggcgatggaatccattggtgatattgcgacagtaaccgtacacattaaaaagattcgtgaaaagattgaattaaatacagcaaaaccacagtatattgagacaatctggggtgttggatatcgtttcaaagtctgaaaaaatatacttgacaaatacgcaagaatatcgtacagtaaagtggtaaaaacaaggggagcttatttgataggctgagaggaagttaagaacttcgacccataacctgatttggataatgccaacgtagggacagacgtatgaaatgttgcgggagatgtcagaagttggcacctcccgttttttatgtatcctcataatcaagcacagaaagattctgagtgtacgatgtttttaattatttgacaattgaataagtaataccaagtgattgaatgagagttcatgaaggggtgcaccaccgcgggtgtatttctttcgtgaactcttttttatttcattaaaaagttttgtcatgaaaaataaaaaacatgttctacaaaatgccaaacaggaaaattaagaaagtacatcaagaaagtgaggagtttagaatgattaaagtaaatggaagagagcgagattttgttccgaataccaccattgcacagctcttagagcagatgggttacaacctgactcgtgtagcggtagagtgtaatggaaagattgttccaaagaagcatttagctgaaacattaacaacagatggagacgtcttagaagttgtaagttttgtaggaggaggctgagatgttaacaaaagaagaaatcagggaggcgcttgttgagcgtcattcggaggaagttcaaagtaaattagatgaggcaaaagtggcgattgcaggacttggcggacttggctcaaatattgcattttttcttaccagaatcggtatcggacatctgcatctgattgattttgatagagtagatattacgaatttaaaccgtcagcagtatcgcatggaacatattggcagatacaagacggaagcacttttggaggaacttcgggaaatcaatccataccttgaggtagagacagactgtgtgagagtgacggatgaaaatgtagggactttatttcacaatgaagacattatctgcgaagcattcgaccgtccggaagcaaaagcaatgttagtcagcggagtaggagaatattatccggataagattttagtcaccggatccggcatggcaggctatggaagaagcaacgagattgtgacaagaaaaatcaatgagcatttttatttatgtggggatgcgcataccgaaccggtaaagggaagagggcttatggcaccgagagttgcaatctgtgcagcacatcaggcaaatctgattacagaactgattatcagaggcaaatagagaagagaaaaagaaagttaaaaagaaaataaaataagaaaaaataggatatagaaaaccagatggaggaaaacaaaatgaataatgatacatttacacttgggggacatacatttgagtctcgttttattttaggttcaggaaaatattctctggatttaattaaagcagcagtggaaaaagcaggagcacagattattacattggcactgagacgtgcaaatgagggaggaatggcaaatatcttagactacattcctgaaaatgtcacactgcttccaaatacatcgggtgcaagaaatgcagaagaagcagtgcgtattgcaagactttccagagaactcggatgtggagattttgtaaaaatcgaagtcatccatgattccaaatatctgtttccggataactatgaaaccatcaaggcaacggaaattctggcaaaagagggatttgtcgttatgccatatatgtatccggatttaaatgtggcaagagaacttcgggatgccggtgcagcgtgtgtaatgcctcttggttctccgattggttcaaataaaggaatttgcacaaaagaatttattcagattttaattgatgaaattgatttaccgattattgtagatgcaggaatcggtaaaccatctcaggcatgtgaggcaatggaaatgggggcagcagcagttatggcaaatactgcaattgcaacagcaggtgacattccggcgatggcagaggcatttaagcaagcaattgaagcaggaagagccgcttatctggcaggtatgggacgtgtcatggaaaaaggagcaagtgcatcttctccgcttaccggatttttacaggattaagagcggggggagaaaaaagatgagtacagaaaaccatgtaaatgagagtattttaaatgatgaaattaaagagtggcagaagaaaaaccgtatcgaccacatgacttatttaaaaggaatggaagtgcttgagtccgatgtgcagaaacaggtcattgatgccatgaatgagtatgactatgagaaatataccgcaaaggatgtagaacgtgcccttgcgcatgagagccgtactccggaagattttgcggcactgttatcaccggcagcactgccgtatttagagcagatggcacaggctgcaaaggcagaaaaagaaaaacactttggaaatggtgtcaatatgtttacaccgatttatattgcaaattactgtgaaaatttttgtatttattgtggatttaactgccataataaaattaaccgcgcaaaattaaatgcacaggaaatcgagaaagagatggcagcagttgccaaaacaggacttcaggaagttttgattttgactggagaaagtcgaaaatattcggatgtgaaatacataggagaagcctgtaaaatcgcaagaaaatattttaaagtaatcggtcttgaggtttatccgatgaattctgatgagtatgcttatctgcatgaatgtggcgcagactatgtaaccgtattccaggaatcctataattcggataagtacgaaacgctgcatcttgcaggtcataaacgaattttcccataccgcttaaatgcgcaggaacgtgccttaaaaggtggaatgagaggtgttggattcgccgctttgcttggtctggatgatttcagaaaagatgcgtttgcaacaggtatgcatgcatatctgctccagagaaaatatccacacgcagaaattgcattttcctgtccgagactgcgtccgattatcaataatgacaagattaatccgatggatgtccatgaaccacagctgcttcaggtagtatgtgcttaccgcctgtttatgccattttcgagtattacggtatcaaccagagagtgctcccgtgtgagggataatctggtcaatattgcagcaacaaagatttcagcaggagtcagcacgggaatcggagaacacgtagaagagattgagaataaaggagatgaccagtttgaaatctcggatggaagaagtgtggaagaagtctatgaggcacttcttgatgaaggacttcagccggttatgaatgactatgtttatgtataaagaacaggtaatagcagttacgaatcgaaaactctgtcgagacagagaagcgtttttatggcagataaaaagaatctgcaagaatcagcctcatgctgtgattctgcgtgaaaaagacctttcagaaagtgaatatacagcacttttgttttcggtaaaaaagatttgcgaggagcataaggtaagttgtattgcacatacttatacggaatcggcacttgaagtcggatgcacgaaaattcatgttccgcttgctgttttagaagcaaaccctgagattgcacagaagtttgaagtgacgggagtttctacacacagcaaagaagatgcaaaaaaagcgcaaaagctgggtgcttcttatgtgacagccggacatatatttgcgacaacctgtaaaccgggacttgaaccgagaggaacggcatttttaaaagaagtgtgcgatgaggtggaaatcccggtgtttgcaatcgggggcatgaaaacaacgagggaatgtgtggaggaaatgcgaaaactgggcgcttcaggaatttgtgtcatgtctgagtgtatgaaatggatctgactgcgtaaaagaaatttcagcttgcaagaacgtacaaaatatgctaagattccatcgaaagcagtattatttgaaataagaaaagcgatgaagagaaatagtagatattagtcctatgtacagagagaagccggttggtggaaggctttgataagatggtatcgaaccggtcttggagctgcaggttgaaattgagccggaaatttatcaggcataagaaagtagacactgtcggaagtcccccgttaaaaggaaatgatatcgaggaaactctgtatctatgagtgtgggagtaatcctgaattcaggtggtaacacggatgaatattcgccctgaactgattgaagaaatttgtcagttcagggttttttatttcattaattaatttcattttttgttgagtttaaagattttttaggaggaagtaaatatgaagttaagtaaacttgtaggagacagatttaaagaaagaccgtctgactgtgttatcgacagtcatgcactgatggtaagaggtggttacatgaagtatgtggcaaacggaatttattcccagtatatgccgcttcgtcgtgtatgccagaaaattgaagcaattatccgtgacgagatggataaaatcgatggacaggaagtacagtttccggttgccctgccggcatctttatgggaagaatccggaagatatgaaagcgttggaagtgaactgcttcgtttcaaagacagaaacggaagcaaaatggtacttggtatgacccatgaagaggcagcggttcagttagtaagagaatatggacagacttacgcaaaatatccatttatgatttatcagttccagacaaaattccgtgatgaagcacgtccaagagccggtctgatccgtgtacgtgaatttactatgaaagatgcgtattctttccacacatctcaggaagatttggaagaatattatgacaaatgttatcatgcttatgaaagaatttttgcaagagccggaattccggaaacaatcgcagttgcatctgactctggtatgatgggtggaagcctttctcatgaatttatgcttttgactccggttggagaagattccattgcagtatgcccggaatgtggttacaaagcaaatgtagaggcagcagaaaacattgtagaaaatgaagctgaagaatatcaggaattaaaactggtgagcactccaaatatgcatacaatcgaagaagtatgtgaattcttaaacagctcagcagaaaaatcctgtaaagcggtagtatatcagaaaaattccaatgatgaatacgttgtattatttatcagaggggacttggaagcaaatgaaacaaaactgacaaacttcttaaaagaagaaattcatccggcagaaattaccttagaaagtggattacatccaggatttatcggaccttacaagatggatgcaaatgtaactgttttatatgacagttctttaaaaggtggatgcaatctttgctgtggcggaaatcaggatgattatcattacacagggctttgtatggaaagagatcttccggatgcagaatatcatgattttgcaaaaatcgtagatggcggaatctgcccatgttgtaagaaaaaagcaatcaaagtatcaagaggtatcgaagtcggaaacattttccagctcggaacaaaatatacgaagagcatgggaatgaaatatctcgataaagacagcaaagaaaaatatccgattatgggatgttatggaattggtgtcggcagacttgctgcatctgtctgcgaagcacatcatgatgagtatggtccaatctggccaatgacaattgctccatggcaggttcacctttgctgtgtacgtccggacaatgaagaaatcaagaactattcagatggtttatatgaacagttacagaacgcaggaatcgaagtactttacgatgacagaaaagtaagtgccggtgttatgttcagcgatgctgacttaatgggtattccggttcgtatcattgcaagcccaagaaatatgaaagagggatgctgtgaagtggtaacaagagataaatctgtaagagaaaaagtagcattagaggatgtatttgcaactgttcagaaaatggtacaggaagcacttgcaagataagttaaccgaatgaaagagtgaagtggattgtgaatatccaccggacaaatataagaaattaaaaaaatgaaaaaatatatcgatgaagcattatatgaatacagcaaaggagaggtttatccatttcacatgccggggcataagcgcagcttctgccctgagacattaaaaaatccttatgaaattgatattaccgagattaccggatttgataatctgcatcatgcggagggaattctcttagaagcacagaaacgtgttgcaaagttgtaccatgcagataaaagcttttatctgataaatggaagtaccgccgggcttttaagtgcaatttcagcatgtaccagtgatgggggcagtattttgatggcaagaaactgtcataaagctgcctatcatgcagtttatttaagacgtctgcatgcacattatttatatccggctgtgtttgaagagacagaattaaatggcggaattacaccgaaagcggtagaagaagctttgaacgtctgtcctgagatagaagcagtactgattacttcgccatcttatgacggaatggtgtctgatattgctgaaattagtgagattgtacacgcacatcaaattccactgattgtagatgaggcacatggagctcatcttcgtttttcagatacatttccagagtctgcacttgaaaacggcgcagatatcgtaatccagagtctgcataaaactttgccttcattgacacaaactgccctgctgcacacgcagggcagtcttgtatctgaagaacggttgaagcggtttctttcaatttatcagagcagtagcccgtcttatgtttttatgagcagtatggatgcctgtatccgactgctggagtcttcttcggaagtgttatttaaagaatacacggtacgattaaaggagtgtcgcagaaagctttctgatttgaagcatctgcatctggtcaaaccggatgaagtagtcgggaaaaatggcgtctatgatatggattgttctaaaattattatttcaacaaaggggacttctattgatggagagatgcttcggaaaaaactgcttgataaatatcagttagaaatggaaatgaccgctccgtcttatgtgctggcactttcaagcgtgatggacagtgaagaaggatttgcacggcttgcaggtgcacttttggaaattgattcggcatttgattctgagatgaaaaatcaaataaaggagaaagcgcagacaaaaattgagtttacagataaagatgcaatatgtaccattgcagaggcgatggatgcagactgggaagaagtgaatttaaaagaagcagaggaaagagtgagtacagagtttgcgtatctttatccaccggggattccgtgtattgtgccgggagaaagggtaacaaaagagctgattgaaaaaatagagagctggaaaatgcaggggcttgaagtacagggattgattgattatcatgcacagaagattcgtgtgcaaaaaaggtgaattatgggaaaaatattttatatcatgggaaaaagttcttccggaaaagacaccatctaccgaaagcttcaggaatcagagaatttaaagcttggaagactggtgctttatactactcgtccgattcgtgacggagaaaaagaaggacaggaataccactttgtagatgaggcaaagtattttgaatttgataaagcagaaaaagtgattgaagcaagaacctatcagacagtttacggaccgtggacttattttacagcagatgacggctcggttgatttaagcaaaaccagttatcttgccattggaacgcttgaatcctatcagaatctgaaagcatattatggagtagcgtcgctgtgtccgatttatgtggaggtggaagatggggagcgtctaaaacgtgccattgcaagagaggaaacccagaaagaaccacattatgaggaactttgtcgtcgttttcttgccgatgcggaggatttctcggaagaaaaattagagcaggcaggaattgaaaaacgattttttaataaaagtttagagacgtgtctgagtgaaataacagcatatatcaaaaaacgcttaatagaatcttaatagaaatgttagagaaggaattattgagtgcatttcaatcgtgtggtataatgagaacatattcgaaatggtatcatgttatggtatcacgttatcattttgagacatacaagacattattaggacaaggtgggtgattgcaatgcaggaagttgaaaaagtattgggacacgaagaggtaatccgtcatttgcagaatgcagttgagaaggaacaggtttcacattcttatatttttgcaggagaaaaaggaagcggtaaaaaacttctggcaaaattatttgccatgacattgcaatgcgaggaacataaaaaagagccgtgtatgcattgcagttcctgtagaaaagcaatgagccggaatcatccggacattatctatgtggagcatgtaaagccgacttcgattggtatcgaagaaatccgcgaacaactggtttcggatgtggaaatcaaaccgtataccggtccttataaaatttatatcgtagatgaagcggagaagatgacgatacaggctcaaaatgccctgttaaagacaattgaagaaccgccggcttatgctgtgattctgcttttggcaaacaataataccggacttttgccgacgattacttcaagatgtgtgacactgaattttaaaccggtgcgcgatgaagtcattcgtaagtatctgatggaagaactgcatgtaccggattatcaggcagatgtcagtgtggcatttgcacagggaaatgtaggaaaagcaaaacagattgcaactgcagaagattttacagaaatgatggatgcggctttccgtatcttacgtcgtggaagcgatatggaagtttatgaaatggtagatgcactgaaaaacctttctgaacagaaacatacgatttatgagtatctggatttgtttttagtatggtttcgagatgtgttgttatttaaggccaccaaagaaatggacagtctggtttttaaagatgaatacaattttatcaaagagagagcagataagagttcctatgaggggcttgagaccattatcaaggcgattgagactgcaaaagcgcgtttgcaggcgaatgttaattttgacttaacaatggaactattgttcctgacaatcagggagaactaataaatgacaagagtaataggagtcagattccgtaacgtgggaaagatttattatttttcaccgaaggattttgatatttgtgttggagaccacgtaattgtggagacagcgagaggagtggaatacgggcatgtcgtgcttgctccgagagatgtggaagatgaaaaggtggtacagcctttaaaagaagtaatcagaattgcgactccacaggatgacaaaaaagaagaggcaaaccggaagcgtgaaaaagaggcgtatcagatttgtttaaagaaaatcagagagcacggactcgagatgaaactaattgatgtcgagtatacctttgataataataaagtattattttattttaccgctgatggaagaattgatttccgtgagttggtaaaagatttggcagctatctttaagacaagaattgaactgcgccagattggtgtgcgtgatgagacaaaaatcttaggtggaatcggaatctgtggacgtccgctgtgctgtcacacttatctttctgagtttgcaccggtatccattaagatggcaaaggaacagaatctgtcgttgaatccgtcgaaaatttccggtgtatgtggacgactgatgtgctgtctgaaaaatgaggaagaaacttacgaagaattaaatcgcaaacttcctggaatcggtgacagagtgaccaccgcagatggtttaagaggagaggtgcacagtgtcagcgtgttaagacagctggtaaaagttattgttgatgtggatggcgaaaaagaaattcgggaatatccggtggaagacttaaaattcagaccgcgtcagaaaaaagaaaaattccgcctcagcgatgaggaaatgagagctttaaaagaactggagaagaaataaatgaaagacaagaatgaacgtcttgatgaccttcaaaatggctatatgctctttcagaatccgaaacagttctgttttgggatagacgctgtccttcttgcctggtttgcaaaagccaagccgggtgagagggtacttgatatggggacgggcacaggaatcgtccctattttaatgaaagcaagatatccgaaaggatattttacaggactggaaatccaagaagaaagtgcagatctggcaagaagaagtgtcgcatataataaactggaacaggatattgatatcgtaaccggagatatcaaagaagcaggtgcagtgtttggcggcgcttcttttgatgtcgtaacgacaaaccctccgtacatgattggaagtcatggactaaccggagaaaacagtgcaaagacgattgcaaggcatgaaacgttgtgtacactggatgatatcatagctcaggcagcgaaggtgcttgtgccaaagggaagattttatatggtgcaccggccgtttcgtctggctgaaattatgtcggttatggtaaaatataaaattgagccaaagaggatgcgtctggtacagccttatgcagacaaagagccaaatctggtcttaattgaaggactgcgtggaggaaaatcacggattgaagtggaacgcccattgattgtgtatgaaaaaacgggtgtttataccgatgaaattcttgatatctacggaagaaatcatgaggaaaaattatgagtggaaaattatatttgtgcgcaactccgataggtaatctggaagatatgacgtttcgtgtggtgcgcacattaaaagaagtggatttaattgcggcggaagacaccagaaacagcattaagcttttaaaccattttgaaatcaaaacaccaatgaccagttatcatgaatacaacaagattgataaagggcattatctggtagaacagttattagaaggaaaaaatattgcgttggttacggatgccggaacgcctgggatttccgacccgggagaagaactggttgcgatgtgttatgaggcaggaattgaagtgacatcccttccgggaccggcagcctgcattacagctttgactttatccggactttctacacggcgctttgcgtttgaagcgtttttaccgtcggataaaaaagaaaaaaagaaaatattagaagagttaaaaacagagactcgaaccatgataatgtatgaagcaccacatcgtctgcttcgtaccttagaagaattatttgaaacccttggagatagaaggcttaccgtgtgtcgggaactgacaaagaaacatgagacggcatttgtgacaaccatttcagaagcccttaagtggtatggaaaacatgaaccaaaaggggagtgtgtacttgtaatcgaaggaaagaaccgaaaagaaatggaagaagaagcccagaaaaaatgggaagagatgccgttagaggaacatttggaacattatatgcaacagggaaacgacaaaaaagaagcaatgaaaaaggtggcaaaagacagaggaatcagcaaacgtgatgtatatcaggcactgctgaaaaaggaataaaaatgaagcagatggataaaaaagacttaagcaaaaaggcaaaaatatggttcgaaaaggcaaaagaatggcttaaaagagcaaaagaagccttaaagaaactggaattaaagaaaaaatatgagttgtttaaggaaaagctgccggaggataaaaaagcaagaacgattattctggcagatattgtattagtggttttattgatttttacactgcttctggtaggatgtaaaaacctgttgaccggaggaaagaagcaaaaagaagagacagccatttcagaagaaatggaaaaaacaacaaaacgaaaaaataaaacggtaagttttaccattagtgcagtgggagactgtacatttggaacggatgaaaattttgcttatgagggcagtatgccggcaaaatatgatgaggttggagattttaattatttctttgaaaatgtaaaatctgtttttgaagcagatgatttaacaattgtaaactttgagggtacgctgacagacagtacaacccgtgaggataaacaatttgcgtttaaagcagataaaagctatgcggaaattttaacagatggctttgtagaggctgccaatcttgcgaataatcacagtaaagattatggtgaacagagctataacgatacgatggatgcacttgatgaagccggaattacaaactttggttatgacagggtagcaatcaagaaagtaaaaggcatcaaggttggtctggttggtacttacgtgttggcagatggtctgggcgtgaaagattccatggagaaaaatattcaggatttgaaggatgagggcgcacaggttatcattgcgagttttcattggggagaggaaaaagcagagtatccaaatgatgtgcaggtagaacttgcgcatgctgcaattgatgcaggagcagacttggtgcttggacatcatccacatgtacttcagggaattgaacagtataaaggaaaaaatattgtatacagtcttggcaatttctgcttcggtggaaatatgtatccatctgatatggataccatgattttccagcagacttttactctaaaaggtggaaaactgcaggaagataatgtgacaaatatcattccatgcagtatttcttcggtagaggactataataattatcagccgacaccggcagcgggagagaaagaaacggaaatcttaaataagataacccaaagaagtcagggactttctaatgaaaatacagaagaatctgattcggaaaatgataatagcgattctgatgaaagctatgatgattcggaagatgataatagcggttctgatgagtatgatgattctgacgagtaatattccgattccttcttgtatagaataaaaagaagagtcaaaacaggataaaagtatgctgaatcttttatggggagctatgatgctcatcggcattctgtatggcgcagtgacaggaaggcttgcggaagtaacggatgcagcgttgtcctgtgctaaagaagcggttgcactttgtattacgatgtccggaattgtagcgatgtggatgggaatcatgcagattgcgagaagttcggggttaatcgataagatgacagagaaaatgcagccgcttttgcattttttatttcctaaaataccaaaagaacatccggcaatggaatatatttccgctaatgtcattgcaaattttttagggcttggctggggtgcaacacctctgggattaaaagcaatggaagaacttgcaaaactggaagaagaacgaaaagggaaaaaacccaaatccgccagcaatgaaatgtgtacatttttgattttaaatatttcatcattacagttgataccggtcaatgtcattgcctatcgaagccagtacggaagtgcaaatccggcaggggtgacaggtccggcaatcgtggcaacatttgtcagtacgcttgtggcaatattgttttgtaaatggatggatcgataaaaaagcagtctgcttaaaatttaaccaaatcaagtaagtcccctgcttcaattgcgaaaagcaataagcaggggtggggacttgcttgtatcaggagggggcaagccccttctgataagctgcgtagcagctatttggttatgagcaagtagcgaagcggattgcgaatatccacttgactgcagactgcttttagtacattattcttctttatgtgtgctgaagaattgtttctgacggatatagtaataaataataaacaggatagatgtaacaccccaggagatcggatagcacatcagaataatttggattcctgaaaaatgcggtacaacaaagaaaatccataaaatacgaagtacgcagacaccgccacaggtcatcagcatgggaatcataacatctccaatcccacggagagcacttgagaagatttcaataaagataaataaaacatagcttggtgcaagcaaggaaataatttccattccgactttgataacgccggcatcctgcgtaaagagccggaagagatagtttccaaagaaaatcaaaatcaggcttacaagcagagaggcagcaaggtccatcaaaagacagacagttacgcttcgtttcatccttgaatattttccggcaccatagttttgtccgacaaacgttgcaatcgaaaccgaaaatgcaccggaaatcatccagtaaaaggcgtccatttttccgaatgcagtataggctgccattgcatctgttcccagatgatttaaagaggactgaataatgatattggcaatattgtacatcatagattgaaagcctgccggaagtccgattgtaagaatagagaaaagcaaaaatcggtgcaggcggatttttttcggttcaagctgatacatttcttctggtttcatcaaagcacgaattaccaaaatggcactgacagcctgagaaaataaggttgcaagggcagcgccggtaatgccaagattaaatccgacgaccagaaaaatatccaaaaatacattaataaagcagcagacaatcagataataaagcggtcgtttggagtcacccatggcacgcagaatggccgaaccaatattgtagacaaagacaaagaaaattccggcaaaataaatacgcagataaatgacagaaccggtcattacatttgacggagtattcataaaccggagcatagcgggagcaagtaaaattccaaatacggtaattatgatgcttccgataatggcaagggctgaagctgtatgcagtgccagatttaattcttttttattctttgcgccatagtagcgtgcaatgatgacggttgcaccggaagaaagcccgacaaagaatccgacaacgagattgattagctgtccggaagagccaccaacacaggcaagtgcttcttttccgacgaagcgtccgacaataatggcatcggcagtattgtaaagctgttgaaataatgttccgagcataatcggaaaaaagaaaagcagaagctgtttccagataacaccctccgtaatttgattgacagcagaagttttttgtttcatgactacaccccctggttaaaaaaataaatcaatctgctacttacatatatagcatacaatttcacgaaagtcgatatcatgttttacaaatttttggcgaaaatgtggtataatagacacaagaatttttttgaaaggtgatgttaagtatggaggtaaaattacgagtagcagacccggccggaaatatcacaatttttgttaccagtccggtggaaagaaatttatatgcaaaggttgcaaatgaactgttagcaatcaaagagttccgtggagaacaggttggtttcattgaaagacatgaagatggaagcagtcacatggaaatgatgggtggagaattttgtggaaatgcaaccagaagttttggctatctgcttggaaaggagcaagagtcaaaggacgcctacaaaaagacggtaactgtagatgtcagcggttcttctgaaaaacttgacgtggaagtagattatgaggcaggaacaagtaaaaccatgatgccgcttcctgaaaaaatagaagaagtggaaactgctcagtacggaagctatccaatggttgtctttgacggaattaatcatgtaattgtaaaaggtccaagaagagaagatgcgtttgtacaggcggtgcttgaagctgcaatggcaaaacataaatgtgatgcgtgtggaattatgttcttagagccaagtgcagatggaatggaaaaacgttaccggatgacaccggttgtctatgtagaagaaacaggttctcttgtatgggaaagcagttgtggaagcggaagtatggcaacggcggtttatttaagcaaacagaagaatgatggaaaatatgtttatattttaaaacagccagggggaattattgaagcaacggtcgtaaaggaaaatggaaaaacagtagaatgtaagatgggcggaccggtttctgtttcattagaaaaaacagttgaggttaaggtctgattgatgaagcggtatcgtctgtgtaatccgtttccatcaatcgaaaaagaaggcagtctttcttatgggggaaatcagaattggagcagttctaagactattcgcaaatgcggatgcggagtgattgcaggaacggatttattgttgtaccttgatttaaataaacaaagatgcagaacaaagttttttgaagaagtgcaggattcaaacggaattatcgaacgggaacagtacttaaagtatgtccataaaatgagacgagattatcttccgctgattccacactttggtatgccgggatgggtgctggtagtgggcttaaatgcttatctggcaaaatatcacaccggcttgacggcaagctggggatttggacgcaaaaagttatggaaccgcatgagtgccatgctatctcatgatattccggttattttatccattggtccgaatctgccatttttccggaaaaaagaaaaactgaatctgtatcagaaaaacagtatgggaagctatctttcctcgaataaggtatctgcgcattttgtgacagtcacagagatggacgaagaatggatgcgggtttcttcgtggggaaaagagtactatattaataaaaaagagtatatcggctatatgacaaagtatagcaatgcattattttgcaatgtgtgttacatacgaaagcggaaatagctgaaaaaattcaaaaatctaaaaaaattatacattgcatttttcttgattttggtatatcatcctaatcataacaatcgacaaaaaattaacgagcataagaaaagcggaggagtataccatgaaagagcaaatcatatcctttaagacagtagaagaaattaaagaatttgtaggagcagcctgtaattgcccgtttgatatcgacgtggtaagcggaagaattacaattgatgcaaaatcaattctcggaatgttaagtgtgaactggcaggaagaactttgtgtcatctatgaagcacagaatgaaaaatttgatactgttgtgcagaaatatgcggttggataatgcatctgctacctttacaaaatcagaaaaatgtgttagtctctaaaaagatgacaaacacgatgacggagagagtacgcattgcttttcttttacagagaaattccggtggctgagaggaatgaagaaaactttggggaagatggctcctgagaggtgcaccgaacctgtaatttagtaaaatcaggtaaggctgcaacaggttccgcctgttatagcgggagaggtgtgaaagcacccattaaggtcttggctgtgaggctaagataaaaagaagtggtaacacgggtatatagctcgtcttctttcattctgaaatcaatcaggatgaagaagatgagcttttttggtttgtcaaaaaaattgattcaaagaaacccgttaaacaaaaatgtacgctcggaatctttctgtgtttgattctgtgagcacatagaaaaaagtaaaggagaaaaaatcatggataagaaaaaatattatattaccacagcgattgcctatacttccggcaaaccgcatattggaaatacttatgaagcagtacttgcagacagtattgcaagatttaaaagacagcagggatacgatgtattcttccagaccggtacagatgaacatggacagaaaattgagttaaaagcagaagaggcaggtgtaacctgtaaagaatttgttgataaagtatctggagaaattaaaaacatctgggatttaatgaatacttcttatgataaatttatccgtacaacagatgctgaccatgaaaaacaggttcagaaaatctttaagaaactgtacgaccagggagatatctataaaggatactatgaaggaatgtactgtactccttgtgaatctttctttaccgaatctcagttagtcgatggaaaatgtccggactgcggacgtccggttacaccggcaaaagaagaagcttatttctttaaaatgagcaaatatgcaccgagactgattgaatacatcaacgagcatccggaatttattcagccggtttccagaaaaaatgaaatgatgaacaacttcctgcttccgggacttcaggatctctgtgtttccagaacttctttcaaatggggaattccggttgattttgacccgaaacatgttgtttatgtatggttagatgcgttgaccaactatatcacaggaatcggttatgactgcgatggaaacagcacagagcagtttaagaaagactggccggcagatttacatctgattggaaaagacatcatccgtttccataccatttactggccgattttcttaatggcacttgatttaccacttccaaaacaggtatttggacatccatggctgcttcagggcgatggaaaaatgagtaaatccaaaggaaatgttatttatgcagaccagttagttgatttctttggagtagatgccgttcgttattttgtactgcacgaaatgccatttgaaaacgatggtgtgattacatgggaattaatggtagaacgtttaaattctgaactggcaaatacccttggaaacctcgtaaatcgtacgatttccatgtccaataaatattttggcggagaagtaagaagtacaggagtgaccgaaccggttgatgaagaattaaaatcagttgtacttggaaccaagaaaaaagttgcagataaaatggaagagctgcgtgtcgcagatgcaatcacagaaatctttactctgtttaaacgttgcaataaatatattgatgagacaatgccatgggcacttgcaaaagaagaagataaaaaagaccgccttgcagaagtactctacaatctggtagaaggtatctgcatcggggcttctttactcgaatcctttatgccggaaacaacagaaaagattttagctcagttaaatgcaccgaagagaacttatgaagaacttgatacatttggtttatatccggctggaaacaaagtaacagaaaaaccggaaattctctttgctcgtcttgatatcaaagaagtgatggaaaaagtagaggcaatgaagaaaaaagaagccgaaaaagtcggaacagcagaagaaaagaaagaagaagcggtaattgaaatcgaagcaaaaccggaaattacatttgatgatttcatgaaaatgcagtttcaggtaggtgaaattattgcctgtgaagaagtgaaaaaatccaagaaactgctttgctctcaggtgaaaatcggaaatcaggtaaaacagattgtatctggaatcaagtccaattacaaaccagaggatatggttggaaagaaagtaatggtattggtaaacttaaaaccggcaaaacttgcaggtgtactttctgaaggtatgctgttatgcgcagaggatgaaaatggtaaattggcattaatgacaccagataaagagatgccggcaggtgcagaaatctgctaaaataagagaaaactttctgatatgtaaattacaacagacctccataggtaagatgaaaatcggactatgggggtcttttcctaaaaaggagaaagaaatgatatttgaaacacatgcacactatgatgacgaggcgtttgatggggacagagacagcctgatttgggcgatgcatgaacatggaattgataccattatcaatgttggggcaagccttagaggggtaagagaaacagtaaccttgatggaacgctatccatttgtctatggcgcaatcggtgttcatccggatgaagtcggagatttggatgaagaaaaaatcgcatggatgcgtaagctttgtgaaaaagaaaagacagttgccgtcggtgaaatcggcctggattactactgggataaagagagccatgaaattcagaagaaatggtttgtgcgtcagatggatttagcaaaagagatgagcctgccgattattgtacacagcagaaatgcggcaaaagataccatggatttgatgaaggcagagagggcggattatttaagaggagtgattcactgttattcctattctttagaacatgcaaaagaatacatgaatatgggatattatcttggaatcggcggtgttatcacatttaaaaatgcaaagaaattaaaagaagtagtagaatatgcaccgcttgattatttactgcttgagacggactcgccttatctggcaccggaaccgtatcgtggaaaacgtaactgctcgttgtatttaaattatgtggcagaggaaattgcgagaattaaaaaaatttcttatgaagaagttgtcgagacaacgaagaaaaatgcgcaggaattatttggcgtaaaataagaaaaaatagagaaaaataagcaagaagaaggcttgcttttttatataccgattggtataatagagtacaacaaagacatgcagacagccggagggcagtttatggataataaagaattgataaaaaagtcagcgttgaaccttttttatgcaagaggatatgacgcagttggggtacaggaaattgtaaacactgcagggattaccaaaccaacgctgtattactattttggaagcaaacggggactgcttgaaaatctgctacagagtggatatcagcagttagaggatgaaatcctggacgcaattaataaaagcggagatttaaaagacgtgctttatcgtgttgcgcgcaccttttttgattattgtagcaagcatcagaaattctatttattcatgctgtctcttttttatctgggaagagaaaatgaagcttatcaggtggttgcacctctgattgagcggcattatagaatgatggttaaaatttttgaagatgcggcaggacagcttggaaatatgagaggacgtcaggaattatttgcggttggatttaccggtgtattaaatcaccacattctgactgtaaattacagtctgaaagaaggcgagacgtttcacatttcgaatgagacaacgtatgagattgtgcatcagtttttacatgggatttatacctgaaatggctgcggggtttgacagaaaaagaaaaaataaaaatataaatgatagaaaattatcagtttaaagaaggggaaagcttatggcgaaaaatcaaactttaaagattacggagatggatcgttatctgttcggtcagggaacacattatgagatttataaactcatgggagcacatccgacaaaacagaaaggaaaagacggcgtttatttcgcagtatgggctcctcgtgcacaggaagtagcggtagttggagattttaatggatgggatccaaatgaaaacattatgaaatgtgataatgacatgggaatttatcagcttttcataccaggagtcaaatctggagacttatataaattctgtatcacatcaccatcaggagaactgctttataaggctgacccttatgcaaattatgcagaaaaacgtccgggaaatgcttcccgcgtttatgatatcacaaactttaaatggaatgattctgtatggatgaaaaatcgtcagaactatgatgtaaataaacatgcgatgtccatttatgaagtacatccgggttcatggagaaaacatccgcagaatgaacatgatgaagatggattctataattacagagaacttgcacattctctggcagaatatgtaaaagatatgggctatacccatgtagaattaatgggaattgcagaacatccatttgatggctcctggggctatcaggtaaccggatattatgcaccgacttccagatatggcacaccggatgatttccagtattttgtcaattacatgcataaaaataaaatcggtgttatcttagactgggtaccggcgcattttccgaaagatgctcatggactggctgattttgacggcacaccgacttatgaatatgcagacccgagaaagggtgaacatccggactggggtacaaaagtatttgattatgaaaaaaatgaagtaaagaactttttgattgcaaatgcgctgttttggatggaacaatatcacattgacggacttcgtgtagatgcggtggcttccatgctgtatctggattacggaagagaaaatggacagtgggttccgaataaatacggagaaaataaaaacttagaagcgattgaatttttcaaacatttaaatacagttgtgcttggaagaaataaaggaacggtcatgattgccgaagagtctactgcatggccgaaagtaaccgcacatccggaagaaggaggtttaggattcagcttaaaatggaatatgggatggatgcacgatttccttgaatatatgaagttagatccgtatttccgtcaatacaatcatcataagatgacgttctctctgacttacgcatacagtgaaaattatgtgctggtattatcacatgatgaagtggttcatttaaaatgctccatgattaataaaatgccgggacttggacaggataaaatcgaaaacttaaaagtcggttattcttatatgcttggacatccgggtaaaaaactgctctttatgggtcaggaatttggacagtatcaggagtggagcgaagcaagagaactcgactggtatttaacagcagagtccagccatcgtgaattaagagactatgtaaaagagttgctgaaaatgtataagaaatatccggcactttatgcaacagaccacacagagggtgcatttgagtggattaatgcggatgatgcctgcagaagtatttacagttttatcagaaaatcaccgacaggaagaaataatctgttgtttgtcattaactgtacaccggtagcgagggatgattatcgtgtcggtgttccgaaaaagaaacagtaccgtctggtattaaacagtaaagacccgaaatttggtggggatgtgccggtagagaaaaccgtttatatggcacagaaaaaagaatgtgatggaagagaattttctttcgcatatccattaccggcttatggagttgctgtatttacatattaattagaggacgaagtttttggacttttggggtctgaaaactccgtagaaaaagattgtaaagaagcattaaaacagatagacgaaaagagatatacacaaatgttggagaaagaaggaatcgaacagattctgaaatatggaattgcatttcagacgaagaagtgttgtgtaagaagaggcgagttgtcataatttataccggatgtatccccaaaattgatgaaacaaaatatgatgaagtctggtggattgtccgttccccggataaaattcccacaatagaaaagctggtgcaggaactgagtccttcaaaggaagtatttaaagcatacagaaaggcattccaccttggaatctttgatgaagaatactttcaaactgtttatgtacctgattttttagacgaccttataaaaaatcaaagtgcgctagagaagcttggatggttgtgtgaaaaaagcagagaaaaaaatatcatactgggatgttactgtgaggaagaagcgctttgtcatagaagcattatagcgggaatattgcttggaatgggagcaaaaatagaaacgaaagcagagtatatcaaatattttaaccaaatcaagtaagtcccctgcttcaattgcgaaaagcaataagcaggggtggggacttgcttgtatcaggagggggcaagccccttctgataagctgcgtagcagctatttggttatgagcaagtagcgaagcggattgcgaatatccacatgacaacaatggagtttttggtttgagccaaaaactccattgttgtcattttatcatttgttttatcattcgtcgtagatgtttacaatttctccgtctaaaatacggttcatattttttacagcacagaagtttccacacatactgcaggtatcttctttttccggtttggcttcggcgcggtagcgtcttgctttttccgggtcaatacagatatcaaacatttcctcccaatctaatttctttcttgcaaggctcatctggtgatcccattcgatggcaccttttacgccttttgcaatatctgcggcatgtgctgcaatcctggaagcgatgatgccttcttttacatcatcaaggcttggcagacgcagatgctctgcaggagttacatagcagaggaaggaagctccggatgcagcagcgattgcaccaccgattgcagctgtgatatggtcatagcctggagcaatatccgttactaaaggtccgagtacatagaaaggtgcacccttgcagatagttttctggatttccatatttgcggcaatctggttcattggcatatggccaggaccttctaccataacctgtacgtctttttcccatgcacgtgcggtcagttcgcctaaagtaacaagttcttcaatctgggagatatcagaagcatcttttaaacatcctggacggcaggcatctccaagactcatagtgatatcgtattcacgacaaatgtcaagaatttcatcataatgttcatagaatgggttttcttcaccggtcatttccatccatgcaaaaatgatagaaccaccacgggaaacgatgttggtaagacgacggtttgctttgaaacgtcctgcggtggctttattgataccacagtgaatggtcataaagtcaactccatcttccgcatgcatacgcacaatatcaatccattctttggaagtgatttcttttaatggtttgtggtaataaacaactgcgtcataaatcggaacagtaccgatcatagccggacattctttggtaagacgtttacggaaggtgcgggtatctccgtaagagcttaaatccatgatagattcagcccccattttgactgcattgtttactttttcgatttccatatccatgtctttccagtctctggaaattccaaggtttacattgatcttggttttgagcatagaaccgatagcgtttggttcgattgaagtatggagtttgttacaaggaatgataacctggccttttgccatatattccattaattctttgacatccatgttttctttttttgctgcgatttccatttcttttgtgataatgccttttcttgcggcatccatctgtgttgtgtattccataatacattttctcctttcgcatttgattgataagcttttgtttgaagacgtttagctaataaaaaaaggtgcaccccgacaggtacaccttaatcattcacataaaatatgcttcctacgccggcattatccgtatcaggttcatagggtcgaaatccgttcgtatttcttctcaaccgacgcgtcagctccccttttctttgttttttatatcatatcgtctattctgatatttgtcaagcatagatataagaccatttttttaaatctttgataaaatcttcaacagcctgttcatttgttgcccaggaggtgcagaaacgaagacaggtatggttttcatccggtttgcactggaaagttgtgacataattctcattgatttttttggcgaattcattcgggaaaatcgggaaaagctgattggtaggtgaatcgcataaaaatggaatcttgcagtcgataaagccttcttttaaacgctgtgcaagtgccacactgcgttttccaagttcgagatataaattatcctggaaaagttcttcaaactgtacgccaatcatccaacccttggcgagaattgcaccacgctgtttcatattaaaacggaaatgatcttttaaatcatcgtttactaaaatgagtgcttcaccaaacattgctccgttttttgtaccgccaatataaaaggcatcgcataaatccggcagatcttttaaggtcagctgtgtttcttctacggcaagtgccatggcaagacgtgcaccatcgatataaagatacagattatggcgtttgcagaactgataaagtttctcaagttcttcttttgtgtagacggttccgagttcggttgggagagaaatatagaccagacgaggttctacccaatgctcattttcgtgctgttttaagaccggacgaatcaggtcagcagtcagttttccatcggtacaaggaatagagagcactttatgtccgcttgcttcgatcgctccggtttcgtgtgtattaatatgaccggtatccgcactgatgactgcttcataagggcgcagagcatgcgaaagaaacgtaagattcgtcagcgttcctccggtaatgaaatgaatatcaactccataattttccagtgcttcctggattttatcgcgggcattatcgcaatgctcatctaatccgtaagaattattttggtggtagttgatggtttcaagtgcgcgaagaatatttggatgtgctccttcgctgtaatcattctgaaaactgtacataataaaaatccccttttttcaacaacatctttcatctcattctaacacaattttcgtaaaaagaaagtgaaaagatttagaagagaaaattaattgacgatggactggacaatttcgagttagttgtggtaaaatcctaaaatagatgataaacaggggcggaagtactgaaagtggaactttcgtccccttttaccgtgctatacaaaatgtactcttggagtctttaaacatttgttttggaaaggaagtaattgaagatgacaaaaattgatattttttcaggatttcttggagcaggtaaaacaacattaatcaaaaagttattaaaagaggcatataaaggcgagcaggtcgttttaattgaaaatgaatttggtgaaatcggtatcgacggcggtttcttaaaggaagcaggagtagaaattcgtgaaatgaactccggatgtatctgctgctctttagttggtgactttggaactgctttaaaagaagtaatcgcaaagtatgaaccacagcgtatcgtaatcgaaccatcaggagtcggaaaactttctgatgttatcaaggctgttcagaaaatcgaaaacgaagttgaaatcaaattaaacagctttacaactgtagtggatgcaacaaaatgcaaaatgtatatgaaaaacttcggtgaatttttcagcaaccagattgaatatgccggaactgttatcttaagcagaacggataaagcttccgaagaaaaaattgcagcggcacttgagattatccgtggactgaatcagacagcagcagttatcacaactccgattgaaaaactttccggagaaaagattttggatacaatggaaaataaccgctctttggaaaaagaattaatggatgaagaagtttgcccggtatgtggtggacatcatgaccatgagcaccatcacgaccatgaagaatgtggatgcggacacgaccatgagcatgaccatcatcatgaccacgaccatgaagaatgtggatgcggacacgaccatgagcatgaacatcatcatgaccacaaccatgaagaatgtggatgcggacatgaccatgagcatgaacatcatcatgatcacgaccatgaagaatgtggatgcggacacgaccatgaccatgatcatcatcatcaccatcatgcagatgaagtgttcacaagctgggggaaagagacaacaaagaaatatacaaaagaaggaattcatgagattctggaagcactctctaaccataatgacgagtacggaatggtactgcgtgcaaaaggtatggtagagggcgaagatggacagtggatttactttgatatggttccaggtgaagcagatgtacgtgaaggtgcaccggaatacaccggaagaatctgcgtcatcggttctaagatgaatgaagcaaatctggccagattatttggtcttgcataatcaagatacgagagaaaaataacaatacaaataagcttaaggtgtgagtgttgaactgaagttttgacactcacatcatgatatttaagaaaggttatgaaaaatggacgaatttaaagtaccgatttaccttatgacaggttttcttgagagtggaaaaacatcatttttgaattttacactcgcacaggagtattttcagattgatgaaccgactcttttaattctctgtgaggagggtgaagaagaatacgataaaaaagtgctgaaaaaaagccgtacttctgtagaagtaatcgacagcattgaggagctgaccacagagcgtctggttgcttatgatgcattttataatccgggtcgcgttatcattgaatacaacggaatgtggcaggtaagcaaattagaagaactgacatttccgtctggatggggaatcgaacagcatattgtgacagtagatgcaagtacctttcaggtataccttaacaatatgaaatccctgtttatggaaatggtaagaaatgcagatttagtattatttaaccgtgcagataccgaacttccgcttgcaaatttcagaagaagcattaaagttgtaaatccgggtgcagaactgatttttgaagatgaagagggtgaaatcgaggatatctttgacggagaaatgccatttgatgtcaaggccgagacgattgaaattccaaatgaggattatggaatctggtatctggatgcgagagaccatgcggatacttataacggaaagaaagtttcttttaccggaatggtgttaaaatccagagaatttgctaaaaatgaatttgtaccgggacgtatggcaatgacctgctgtgcagatgacacaacatttttaggatttgtctgcaagagcgatgaagcacgtcatctaaaaaccggaaaatgggtgaatgtcgtagccaaagtgaaatatgaatttgtaccggcttacggtgaaacaggtccagtactctatgcgatttctgtggaagagacagaaccgttaaaagatgaactggtatattttagttaaggagctgatatgtatttaatagtaggacttggaaatccaggaaaacagtatgataaaacccgccacaatatgggatttgataccattgatgaattgatagaccgtcatcggattgccggatctggaatcgaccggaaagcgatgtatggcaagggagtgattgccggagaaaaagtcattcttgcaaagccgatgacctatatgaatttgagcggagaagcagtcagggaattaatcaattattataaaatggatgcagagacagaactggttgtcatctatgatgatattgatttggacccgggacagataagaatccgtaaaaaaggcagcgccggtggacacaatggaatcaaaaacattattgcccagcttggaacccagaatttctaccgaattaaagtaggagtcggagcaaaaccaaagggatgggatttggcagattatgtactgggacgttttgataaagacgaacgtgttctggtcgatgaagcaatcaaagaagctgccgatgcagtggaattaattttagcagagggcattgaaactgccatgaaccgttataacgcaaaaaagaaataggaatgaaataaataaattgagggagaaaacatgcaggcacttttgcagccactttcaaaacttggtgaatacgaagaaattaaaaacagaatagagaaaaatcgtgggattttacagcttgccggatgtattgattcgcaaaaagcgcatgtcatttatggactgggtcaggaaaagaagaaccgtcttgtcattgcggaaaatgaattaaaagcaaaagagttgtacgaagatttgaaattttactatccggatgttttttattatccggcgagggatttaattttctttgaagcagatattcatggaaatctgctcacaaaacagcggatgcaggtaattgcagcacttttggagaaaaagagtgtgacggtggtgacaagcatcagtggctgtatggattatcttcttccgatttccgtacttaaaaagcatgtcctgcattttaaaaatgacagtgtgcttgataccgaagcactcaaaaaagagttgattaatatgggatttgagtacaatgcgcaggcggaggcaccgggacagtttgccatgcgtggtggaattgtggacatctttcttttgaccgaggaaaatccggtgagaatcgagatgtggggcgatgagattgattctatccgcagttttgatgccgaaagtcagcgttccattgaaaatctggacgagattaccatttatccggcagaagagatgatacttgatgattcggttttggaaaaaggtctgatatccattgaaaaagagcgggataagacgatacaggcatttcgggatgcctttttgccggaagaagccggacgtatcaaaaatatggtaaatgaagcagtcagcgcaatgcgggaatttcatgatttttcatcagcagaacattttatccgatatttttataaagaaccggtcacttttttagactattttgaggaggaggatacactcctttttttagacgaaacaaatcatcttttagcaagtgtggaagcagtggaaacggaattccgtgagagcatgaagcaccgccttgaaaaaggttatcttctggcaggacagacagatttattatgcgggaaaaaactgctgattcataaaattaatcagaaaaacggcattggaatctgtacgatggaacagcagaaagaggactggcagataaatgattccttttatctgacaaccaaatcggtaaattcgtataataacagttttgaacttttaataaaagatttgaaaaactggaaaaaacggggatatcaggtgttgctgttgtccggttcaagaacaagggcgaaacgtctggctcaggatttattaaatgaaggcttgacggcggtttatacggaggatagaaatcgtgaaatccatgagggtgagattgtaacgacgtatggatatgccagaagcggatttgagtatccgatggtgcgttttgttttgattactgaaagcgatatcttcggaaaagagaagaaaaagaagcgaaagaaaacagaatacagcggaaagaaaattcaaagtttttcagaactttcgattggtgattatgtggttcatgaaaatcatggattgggaatttaccgtggaattgagaaagttaccgtagataaagtagtgaaagattatattaaaattgaatatgcgggtaacagcaatttatatattctggcaactcagttagatttactacaaaaatatgccggagcggatgcacgtgcgccgaagttaaataaattaggcggtcaggaatggaacaagaccaaaacaaaggtgcgtggagcagtaaaaaatattgcaaaagatttggttgctctttatgctgcgagacaggagaagaatggttactgctatgaaccggatacggtctggcaaaaagagtttgaagaaatgtttccatttgaggagacggaagaccagttagcggcgatcgaagcgactaaaaaagatatggaaagtaacaagattatggatcgtctggtctgcggggacgtcggatatggaaagaccgaaattgcaattcgtgcagcatttaaggcggttcaggaagataaacaggtggtctatcttgttccgacgactattcttgcacaacagcattacaatacctttgttcagagaatgaaagattttccggtgcggattgatttgctttgccggtttaagacttcggcagaacaaagaaaaaccattgaggatttgaaaaaagggtttgtggatatcgtaatcggaacgcatcgattgttgtcaaaagatgtggtctataaagatttgggaatgttgattgtggatgaggaacagcggtttggcgtgactcataaagaaaaaatcaaaaaactcaaagaaaatgtggatgtattgacgctgacggcaacaccgattccgagaaccctgcacatgagtctgattggaatccgtgatatgagtgtattagaagaagcgccgatggatcgtatgccgattcagacttatgtgatggaatataacgaagagatggtaagagaggcgattaaccgtgagctggcaaggggcggacaggtttattatgtgtataaccgtgtcaatgatattgatgaaatcacaaatcggattgcaaaactagtgccggatgcaaatgtagcctttgcacatggtcagatgccggagcatcagttggaaaaaattatgtatggatttatcaacggagaaattgatgtgctggtatccacgacaattatcgagactggtctggatatttcaaatgccaataccatgattattcatgattctgaccggcttggtttgtcccagctttatcagcttcgtggtcgtgtgggtcgttcaaacaggacttcttatgcctttttaatgtataaaaaagataagatgctaaaagaagttgccgagaaaagattgcatgccatccgggaatttacggatctgggaagcggatttaagattgcgatgcgtgatttggaaattcgcggtgcgggaaatcttctgggtgcagaacagcacgggcatcttgaagcggttggatatgatttgtactgtaaaatgctcaacgaagcggttcaggaagaaagaggaatggaacaggcagaagagtttgagactacaattgatttggagatggatgcctacattccgccaaaatatattccaaatgaatatcagaagctggatatttataaacggattgccggaattgaaaatgaagaagaatatgaagatatgttagaagaactgatggatcgttttggagaaccgccgaaggcggtacagaatttgcttgcaattgcaaatttaaaggcgcttgcacacagggtttatgtaagagaaattaagcagatcaatcaggaagtaaaagtaacgatgtttgaacgtggaaagttaaaaacggaggggattcctgcaattttagaaaaatataaagaccggatgtctgtgcggacaggaaaagaattttatttcctgatttccctgaaaggaagaaaagcgaaagagttctataaggcgctcgacctggttttggaaattctccatgagtttgaggcattattaccagaaagttcacaaaaaatcccttgctcaaaggaacaataaagattatacttaacaagtacaccaaaagtacatcaaatatcgaatggaaatgaaaatacgggaggaattatgaataaattaggaagggttcttgcctgcacgactcttgcggcaacattgacaatgaccagtttgactggatgtggaagtacattagatggaacgaagacagtagcgacggttggaaaggaagaaattacagccggaacagtgaatatgatgcttcgtatgacccaggctcagatgatgtcttactattccatgtttggaacatccactacaggaatgtgggaaaataaaggcgatgatggcaaaacttatgcagaaagcaccaaagacgacattatggatcagcttcataatctggtattgttagaacagcatgcaaaagattatgatgtaactatcacagataaagaacagaaagaattaaaagccgcagcagaaaaatttatgacagataatgatgcagaaacgattgcaaaactcgcagtgacccagtccgacattgaaaaactgcttgagttatacagctatcagacaaagatgtatgacccgatgacagctgatgtagatacaaatgtagaagataaagaagcacagcagagtaaaattacgtactgcaaagtttctacagaagcgactaaagatgatgagggaaattctacagagttgacagatgaagaaaaagctgcaaagaaagaccaggcacagcaggtattagataaaataaaagcgcaggaagatattgccggcgcagatgtggacagtcttgcaaaagaagtggatgagtcgcttagttcgtctactgcaacttacagcacaaatgaagacgataaagattcctctcttgatgctgacgtaatgaaagcagcaaaagaactgacagaagatggtcaacttgcttctgatgtcatcgaaggcagtgacggatactatgtagtccgtatggacagtgtttttgataaagattctactcagacaaaaaaagacagcattgtaaaagaaagaaaacagaaagcttatgataaactgcttaaaaaatgggcaaagaaaacgaaaatctcagttaataaaaaagtatggaaaacagtaacattaacagatgaagatgtttacagcttcaaacaggctgatacatcaagcgaaacaacagacagtacagattctgcagaaacaacagaagcaacagaaaatacagatagttcagaagcagaagaaagcactgagacaacagaaaatacagaggaatcctctgacagcacacaggcagatgaaaattcagatgcaggtgaaaatgctgatacagaagcaaccgaaacagctgaataataaaaaaagtccgttatcactatttatatttaggtgataacggactttttaacttataaacgactctggcggaatttttttcgataatcccttggggtcattttttgtgctttataaaaagcacgtgtaaaatagttctggtcattataaccacagtgaaatgcaatttctccgatactcaaatcagaagattccaataagcgacggctgtttttcagccgaacctgactgatatgagtatgaatggaaattccgtaagtctctttgaattttctggtgagagaggaacgactgcagaagaactgggagcagaggttatcaatggtgatatgctgtccatagcgttcttcaatgtagctgtggacttctgaaaccaactcttttttcgttaactgcatacggtttgtcagagtaatatactgagcgcagatttccatgattgtaacaagggagtcgattgtctgacggtcactgaccggaatctgggcaatcgtatcctgcaacaattcatagtcatcttttttcatataaggaagcgcttttttgaatgtctcttttgcagcttcttttcctttgttgatggtctgacccatcatcagatatccggttaaagtaccgaaactataaagcggggcaactgcctcatatagccctaagtggcatttataaatgtgaagccgtttttcatcctgtactttacgaaatgccatgatatcctgttctacgcagtgttttcgacctttcggattttcctgtatcagcgaacagagacagccgagttctttcgggaaagcagcaatttcctgaaaataagtatcgtaaacactgatacggaagccggatatatgataaagttcttttaaaatcttttcgattgaaattgtctgctccataaagaattcctccttaaatttcagttgaacagaaaaaatttagatgtattttgtgacaatctgtttcatatcatccattttacgttccatgtcagcaaccagaatcatctgagtgcgagtgcggtcaagattatgatgttctctttggattttaaagtaggtatctccatttaaataatcagtaaggaaacgaagtccacattcgagagtcatcagttttgcagaaaatggaatcagttcaatttcttctttcgttaaagaatcgcctgcttcagaaagaaaaccggcagtgtaagcttcaaagagttctaagctcatggaaactttggttaaatcaatttcatcttcggcagcagtgcttgcgccaaaacggatgctgtcaccaaaatcgtataaaacagaaccaggcattacagtatccaaatcaatgacgcagattccctcgtttgtggtattgtccatcataatgttgttcagctttgtatcattatgggttacacgaagtggaagttttccggcattgatggcatcaactactgtttttccgtcggtttcacgctccagataaaattcgatttcctgctgtacattttttgcacgaccttttttatctgcttttatggccgctttaaaatcttcatagcgggatggagtgttatggaaatttgggatgatttcatgcagggtgtcagctggatagtcggcaagcagtttctgaaaatgtccaaacgcttttgcggcatttttgaagatttcaggagaagaaacggtctgatagcaggttgcatcttcaataaaagtatagcttctccagtaaaccccttcgctgtctttaaaaagggaagagccggattttgtaggaataacagtaagagttccacggcttgggtcttttccctgctcaattagttttttccttaagtgagaagtaacgccttcaatattttccatcaatccataagggtctttaaaaatagaagtattgatagcctgaaggatgtagcggacaggtggtttcgtttcacggctgaaataaacggcaaacgtactgttgatgtgaccacagccaaatggttcttcataaataaatgtaccgttatacagaaactgaggtacgatttcattttttattttttcagagatagacatggttttcctcctgagctttaaattaaattcttatttcttaattatataaaaaagaaaagaaaattctatagaaaactgactcataaatagcaaaaacaggagaaaaagataaaaaatgctaaaatgaaagagggtgggatttttaaggctgatgcagagtataatgaaagaaagaataaaaatggggtgtacagggataagatgagagttctgctgtttttttcagaaatgataattccactgattttattttacgttgtcggtttcggtgtattaatgaaatgtgacatctatgaggaatttgtaaagggcgcaaaagagggcttagagacagtcattcagattcttccaacattaatcgggcttatggtggcagtaggagtcctgcgtgcttcaggatttttgaccatgcttggagaagtgctcggaaaggtgacagagccgtttggatttccgtcggctttagtaccgcttacaattgtgcggatgttttcttcaagtgcggcaacagggcttttacttgatgtttttcgggaatttggaacggattctcgaaacggaaaaattgcttctattatgatgtcgtgcacggaaacaattttctacacagtgtcggtgtactttatggcagcaaaaataaaggatacgagatacacgatagcaggcgcatttcttgcttctgcggtgggaattgctgcaagcgtatggcttgcaggctacatggggtgaaaaaggttgacaaccccaaatttagatgttactatggtagcacgttaaaatatgaaaaatggatattataatggagtgagcgagagaacccacggttttaatcgtttgaaaatacatagaaaggcaagggtcgaaaaagaaaaatgagatattatgataagataacaccagatggaacaaaagatttacttttcggtgaatgtgaacagcgttcacaggtaacaaagaccctgaaggacttgtttacagcccaggggtatcggagggttatgacacccgcacttgaattttatgatgtatttggaaaatcagcggcgaaatatctgccaaaggaaagtatgtataaactgatagaccataaaggaagactgatggtactctgtccggattgtaccgtacctgtggccagattgacggcaaccagattaaaaggaatgccgatgccgcttcgtttattttataaccacaatatttaccgtatgtttccggagttaaaaggaaagagtacagaaatcaatcaggtgggaattgaactgattggcggagaaaaattaagaagtgaccttgaagtggttgaacttgcagcaagatgtttaagtaccatcggaaatggaaaataccgtctggaattatgtgatatcggttactttaaggcgattatgaacagcctggatgtggatgaagacaccaaagaagaaatccgttatcagattgaacagaaaaactatgcttcgcttacagatatgcttggaaaatacaaagacagcaaagcagcgcaggcacttttgaagctgccaagattatttggcggtgcagaagtatttgaaaaggcgtatgaactatttgatgaaaatggcgcaaaagaaagtctggattacttaaagggaatttatgaatacttgcaggcactgggacttggtgatagagtaatcatcgatttgggacttgttaacctggcagaatattataccggaattatcttccgcggttatttccacggaattggagagcaggtgctttcaggcggtcgttacgaccagcttctgcatgattttggagtggaagaatgttctgtcggatttggaatcaatgtagatttggcaagccagaaagtaaaaacggtagaggaaaatataccggaagtgctggtatttgcaccggatacgaagtttttggcaaaagcagtccatcatcgcagagaactggaagaccagggcatgctgacggaaaactgcgtttttgatacaatggaagaagcatttgattatgcaaaaatgagaggaataccgaaagtgcatctggtgggagatgatattaccgtttgtttaacgaagaaaaaataggaagtatagctactcactgggaggcaatgaaagatgaaaccaattagaattgcgcttacaaaggggcgtttagaaaataaaacagtagaacttttagaacgtttaggatatgactgtaccaatgccagaaaaaaaggcagaaaattaattatgccaattggaaatggtgaaatcgaagtcgtgcttgcgaaagcggccgatgttgttacttatgtagaaagtggtgtctgtgacatgggtgtagtcggaaaagataccatcatggaaaaaggcggaacattttatgaagtggcagatttaggatttggaaaatgtcgttttgctgttgcaaccttaaaagagaaagacttatatgaaggctatcgaactttaacgattgcaagtaaatatgtcaatgtcgcaaaaaattattttgaacaaaaaaacatggatgtagatgttgtaaaaattgaaggatccgtagaacttgcaccggtacttggacttgcagatgcaattgtagatattgtggaaaccggtacaactttaaaagaaaatgggcttgttgtaaaagaagaggtgtgtccggtcagtgccagactgattgttaacatcgcaagcatgaagcttagaaaaaaagaaatcgaagaattaatcgataaaatcgaaaaagatattaaaaaaagagcaaaggaggcctagaaaatgacgtatgtattaccggaaaaattaaaagacttaaatccttacgaccctgtaacggaggattttcggatccatcttgatgcaaatgagagtttctgtgaagtaccggaaaacatcaggcaggaaattttaaatgcggtttctaatgttgcatttaaccgttatcctgatccgtacgcaagaaaattatgtgaaaaagcaggtgcatattatcatgtagacccgaaacttttaactgccggaaatggttcggatgaattaatttctctggtagtaccgtattttctggacgagggtgatacgatgcttgtcgcagtaccggatttttccatgtactggttttacgcaccgtttcacaaaatcaaagtagaatcccttcaaaaagaaaacagcatgaagacttctgcagaagagattttacagcgtgcaaaagagaaaaatgcaaaattgctgattttctccaatccgtgtaatccgacttctcttggaatcggacgtgacgatatcataaaaattatcgagggtacagatgcgctggtgattgtggatgaagcttatatggaatttgaaaacgaaaataattccgtcttaaacgaagtagaaaattatgataatttaattgttttaaagacctgttcgaaggcatttggaatggcagcaatccgccttggaattgcagttaccaacgaaaagctgacaggaattttacatgcaatcaaagcaccgtataatgtcaattccgtgacacaggcaatcggatgcgtattattttctcacccggaatatctggcttcctgcattgatgctttaaaggcatccagagacgagttatatcaggcggtgaaagcgatggaagataaaaaaacagaaatcgaaaccgtctacgagacgagtacaaactttatttttatgaaggtaaaacgtgcaaaagaagtgtttgaagcattaaagcaaagaggcatttcgattcgatttatgaatggctatcttcgagtaaccgcaggaacaaaagcagaaaataaagaagtgatggaagcactttgggaactgattcagtaggaggcggatatgagagaaaagcagattataagaaccacaaaagaaacagacatcaatctgactctgaatttagatggaagcggaacgtataacggaacttgcggagttggattttttgaccatatgctgagtgcattttgtgttcatgcggggtttgatttagaccttaagatgaaaggcgatttggaagtagactgtcatcacagtattgaagatttgggaattgtgctgggacaggcatttgcggaagcagttggtgataagggaagtatctgccggtacggaagtttttatattccaatggatgaggcacttggtttttgttccctggatatcagtggacgtccatttctggtatttgacgcagagtttaccaatcaaagtgtaggaacattggactgctgtatggtaaaagaatttttccgggcatttgcatttaacggcggaattacactgcatttgaaatgtttgtacggcgaaaatgaccatcacatcatagaggcattatttaaggcagtggcacatgcattaaaagaagcagtaaagccaaatggcggacaaatcttatcttcaaaggggatgctggcatgatagcaattattgattatggggcaggaaatctgtttagtgtaaaaaatgcattggattttttgcaaaaagaaagtacaataacagaggatgcgcaggaaatccgtaaggctgatgcaatgattcttccgggagtcggagcatttccggatgccatgcgcatgttaaaagaaaaaggacttgataaagttatctgtgaagaagcacaaagaaaaccgctgcttggaatctgtttaggcatgcagatgttatttgagacaagctatgagtttaaagaaacaaaagggcttggactcttagaaggcagtgtcgttccaattgatggaggcggattaaaaattcctcacatgggatggaataatctgaccgtattaaatccatgcaagattacggaaggactaaaagaagatgcttatgtgtattttgtccactccttccgtgcagaaacaaaagacgaaaatatttcctgctatacgatgtacaatgagaaaattccggcacttgtgcataaaggatttgtatatggagcgcagttccatccggaaaaaagcggttcggtgggactgggattactcgaaagatttgctgatttagcgaaaatacaggaggaagagcgatgattatattaccggcaattgatattaaagataaacaatgcgtacgtctggtaaagggagattatgcaactgctcatcaggttgccgaaagcccttatgagactgcaaaatcttttaaagctgcaaatgcctcctggattcacatggtagaccttgacggtgcaaaggaaagaaaaccagtcaatcaggagatttttgaacgtgtggcaaaggaatccggattaaaagtagaagtgggcggaggaatccgtgacatgaaaacaattgaatattatctggagcgtggaattgagagggtgattcttggttctgtcgcagtaaaaaatccggagcttgtaaaagaagctgtaaaagaatttaaagagtgcattgcggttggaattgatgcaaaaaatggaatggttgcaacagaaggctggctggaaaaaagcgatgtcagttatctggatttgggacttgcgatggaagacgcaggcgtaaagactattatttttaccgatatttcaagagatggaactttaaccggagttaataccgaacagcttggacgtttaaatgagaccgtatcctgcaacatcattgcaagtggaggagtcagttccatcaaagatattgaagattgcctggagttgaatctgtatggatgcatctgcggaaaagcactttacacaggagcattaaacttagaagaagcagtgcgaaaggcgggtgtgcagacatgttagcaaaacgaattattccgtgtctggatgtccgtgacggaaaagtggtaaaaggtgtcaattttgttggaatcaaagaagtcggagacccggtggagtgtgccattgagtatgacaaacagggggcagacgaaatctgttttctggatatcacggcgacccatgaaggaagaggaacaatggttgatgtcgtcagaagaacggcaaaacatgtttttgttcctctgacagtaggcggaggaatccgtacagtagatgattttcgtgagattttaagagctggtgcggataaagtctcggtcaattcagcagcagtcagacgaccggagctaattcgtgaagcagcggaaatctttggaagtcagtgtgtggttgtcgcaattgatgccaaacgagatgaaactggcacatttaaagttgtggtaaacggcggaagaattgataccggattaaatgccgtagaatgggcaaaaaaatgtcaggaacttggtgcaggagaaatccttctgacttcaatggatacggatggatgcaaagaaggatttgacctggaactttgcaatgccgtctgtaatgtggtcagtattccggtcattgcaagtggcggatgcggaaaactggaacatttttcggaagtgtttgaaaagagcggtgcagatgcggcacttgcagcttccctgtttcactttaaagagctgactgtcgaagaagtaaaagaacatttaaaggaatgcgaaattccggtaaggagatagagatggattttgaccgttattttgtaaaaggggagttgattccggcaattgtgcaggaagagggaaccggagaagttttaatgcttgcctatatgaataaagaaagcctgaaaaagacatttgagacaggatatacctggttctacagccgttccagacaggaactctggaataaaggtgcaacttccggccatctgcagaaagtggtagatatcaaatcagactgcgatgatgatacgcttttagtgactgtgattcagacaggtgctgcctgccataccggaaatcacagctgtttctttacagatatctggaaagaaggaggagaacgtaattagacgttttttaatgataacaggcaaggtgctcttggcacctttcctgttttgtttattttggatttcaagaatctttgaattatttttaaagatttcaagaccaattgttacgattctatgtgcaatcggttcggtaggaattacaatcggggcaatcatccatatttttttctatcttcagggaagaggaatcagtgtatgggggattgtcctttcggtgttttttgcagcagccctgatggttgtgccggcagcaggtgttggagtggtaatcgtagtgttggagggaatttgcaatggaatttatcgaatgtaccgtccggcgatggaaaagatgaatctggaagaagagaaaaaagattatcatcttgcggaatgtgagtgggatgaaaagacaccggacgctccctggaaaaataaagaagaatgcgaacgaagaattcattattttaaaggggtaaaagataaagaagaactggaaaaacggctttccgggctcttacggatttaccgaccagagaaagaatttgccgaagatgcactgacacgaagcattttggatgaatttgagtatctaaagggcaggcttccggagaaagcaaaagatgtatgatgaaaaatgcaaaaaccgcccgaagaaatcctgtccgagaagttgacaagaccttgaaaagcgatataataaaagaataaagaatgtttaaaattcaattattgtggaggaatttaaaatgaaagtattagttgaaacatctgcaagacatttacatttatcacaggaacatctggaaatccttttcggaaaaggtcatgagctgacagtgaaaaaaatgctgagccagccgggacagttcgcatgtgaagaaaaagtacaggtaatcggaccaaaaagttctttaaaaatgtctgtattaggacctgtaagaaaagatacacaggttgaagtatctttaacagatgcaagagcaatcggtgttacagctccaattcgtgaatccggtgatattgctggttcaggtgcctgtaagctggtaggtcctgctggtgaagtagaactgacagaaggtgtaattgctgcaaaacgtcacgtacatatgactccggaagatgcagaagcagcaggagtaaaagataaagacatcgtaaaactggacatccagtctccaaacggtcgttctttaacattcggtgatgttgtagttcgtgtaagcgcaagctatgcaacagctgcacatatcgatacagatgaagcaaatgctctttgcccaggtaaagaatgctacggtgaaatgattaaataattaaaaacagtcatgattgaaagtcctttagatgagaaaactcatttaaaggactttttttgattggaatcagaggcaaaatcagcgcaaaacgtcatacttgtgcaaaatgcaccaaaaccgtccatgattttcgtatattaataatggttgattttgattgattttgaatgaaaatgattgtataatacagtcatagcaagagagaacaagaaagaacagaacaggagggaaaatatgatttatacagttacatttaatccatcccttgactatattgtttctgtgaatgggtttgaacttggaaaaacgaaccgtaccgattcggaactcttattacctggaggaaaaggaattaacgtttcgattgttttgaaaaatctgggaatcgataatacagcacttggatttatggcaggatttaccggagaagagattcagcgcagagtcgaagagattggcgtaaaggcagatttcatttcaatcgaagacggaatttcaagaatcaacctgaaactgaaaaatattgagggaacagaaattaacggtcaaggaccaaaaatcagcaaagaaaaacgagaagaactgcttcagatattagataaactaaaagaaggcgatgtgctggttttagcaggaagcatcccatccagcttaccggatgacatttacaaaaacatcatgaagcgtctggaaaagaaaaacattctgattgcagtggatgctacaaaagatttacttttaaatgttttagaacatcatccatttttgattaaaccaaacaatcatgagcttggagaaatctttggagtggaattaaagacgagagaatccgtcattccttatgcgaagaaacttcaggaaaaaggagcaagaaatgtgctgatttctatggcaggagagggggcagccctcgttgcagaagacggaagtatttatcttgccgaagcaccaaagggaacactggtaaatggtgtcggcgcaggagattcgatggtggcagggttccttgcaggttggcttgaaaaacacgattacagacatgcattccatacaggaatcgcagccggaagtgcaagtgcattttccgaatatctggcaagcagggaagaggttcaggctgtgtatgagcaggtaacatcaaaagaatataaagaacaataaggaaagagagggagaagtaaaggtatgagaattacagatttactcgatgcaagaagtatttcgcttgactgttcgccaaaaacgaagcaagaggcattggatacagcagttgccctcatggtaaagagcggaaaaattaatgacgaagaagcttacagacgtcaggtttatgcaagagaagaagaaagtacaacaggaataggagaaggaattgcaattcctcatggaaaatgtgatgccgtaacaaaacctggtctcgcggcaatggtaatcaaagatggtgttgatttcgatgcattagacggagagccggttaccctgctgtttctgattgcagcaccaaatacaaaagataatgtacatctggatgtattaagtaagttatctgtacttatgatggatgaagatttctcaaatggactgagaaatgcaaaaagtgtagaagaatttttgaaaatcattgacaaagccgatgatgaaaaaccagacattgatgaacgtcttgaagatacaggagcaaaagaagattccaaagtaaaaattcttgcagttacctcttgtccgaccggtattgctcatacttacatggcagcagagggacttgaaaaagcagcaagagccaaaggatgctttattaaagtagaaaccagagggtccggtggagcaaaaaacgtgctgacagcagcagaaattgaagaagcagactgcattatcgttgctgccgatgcacaagttccgatggatcgtttcgatggaaagaaattaattgaatgtcaggtatctgacggaatcagcaaggcagaccagctcgttgaacgtgcgatggcaggagatgcaccgatttatcaggcaaagggtgcagtacaaaaatccagtcagtcaaagggaagcggaggggttggacatcagatttatacacagcttatgaacggtgtttcccacatgcttccattcgtagtcggtggtggtatcttaatcgcacttgcattcttaattgatggtttaagtgtagatatgaattctcttccggttgaccagagagcaaactttggtacaattactccggttgcagcgatgcttaaaggaatcggtggtacagcattcgcattcatgctgccgatacttgcaggatttatcgcaatggcaatcggtgacagaccggcacttgcagttggttttgtcggtggtatgattgcttctcagggaaaatctggtttccttggtgctttagtagcaggttttgcagcaggatacatcattgtattacttagaaaattatgtgacaaacttccacaggcaattgagaaaattgcaccggttctgatttatccggtagtcggaattctagttatgggattattaatgaacttcgcagtagaaccgattatgggtgcaatcaatactgcattaaataacggtttgacaagcatgggcggttctagtaagattattttaggatttatcttaggtggtatgatggcgattgatatgggtggtccatttaataaagcttcttatgtatttggcactgcagcaattgcttccggtaactacgatgtcatggcagcagttatgattggaggtatgactcctccatgtgcaatcgcacttgcaactttattatttaaaaacaaatttacaaaagaagaaagagatgcaggtcctacaaactttatcatgggactggcatttatcacagaaggtgcaattccatttgcagcatctgacccgcttcatgtacttccggcatgtgttatcggttccggaatcgcaggttctttaagtatgttattcaactgcactttaatggcaccacatggtggaatctttgtattccctgtagtcggaaatccgtggatgtacctggcggcactggtagttggaacaattgtttccactgtactgcttggaattttaaagaaaaaagtagaagaataagaaaaaattaaaattaagaaaataaaaagcaagaaaataaaattaaaacaagaaaaggagaatttaccatgaaagaatttaagtacacaatcacagatccagaaggaattcacgctcgtccggcaggagaacttgtaaaagctgcaaaagagtttgcaagcacaattaaattaaacaaagacggaaaagcaggagactgcaaacgaatcttcggaattatgggactcgctgtaaaacagggaaatgaagttacctttacttttgaaggggaagatgaagatgcagcttatgaagcaatcagcgcattcgtgaaagaaaacctgtaagaaaaaagcagaacatgaaataaagccggggtcaaattagttttgacccctgtttttttaaaggaagaaaggggaagttagcgatgcagatttatagtggaaaaagtgtatttagtggaattgcaattggaaaaatctgtgtatatcagaagagcgagcagcaggtaaaacgtgtacgtacagaagacagtgaaaaagagtgggcacgttataacgaagcaaaagagaaggcattggaccagcttcgtggtttatatgaaaaagcattaaaagaagtcggtgaagcaaatgctgctatctttgaagtgcatcagatgatgcttgaggatgatgactataatgagtccattgaaaatattatccgtactcagaaagtcaatgccgaatatgcggttgcatcgacaagcgataatttttctaccatgttttcgtccatggatgacgactacatgaaagaacgtgctgcagacgtaaaagatatttctgagagaatcctttccctgcttgcaggcggagaaaaaggcaaagtagtgacggatgaaccggtaattattgtggcagatgaccttgcaccgtcagaaaccgtacagttagaaaaagataaagtgctttcttttgtaaccgtgcatggttcggttaattcgcataccgcaattcttgcaagaaccatggcaattccggctttaattggaacagagatgcctctggatgaacgtgtcgacggaaaatttgcagtagtagacggagtaaatggaaaaatctatgtagagccggatgaagagacacttgcagaattaaaagaacgccagagagaagagttagaaaagaaagaactgctcttacagctcaaaggaaaagaaaatattacacttgatggaaagaaaatcatgctgtatgctaatattggaaacataaaagatttagcaactgtcgtacagaatgatgcaggtggaatcggacttttcagaagtgaatttatttatctggaaaaagaagattatccgactgaagaagaacagtttaagatttataagactgcagttgagacaatggcaggaaaacgtgtgattatccgtacgttagatatcggcgcggataaacagtgtgattatttcaaaatggaaaaggaagaaaatccggcactgggatatcgtgcaatccgtatctgcctgacccagaccgaaattttcaagacacagcttcgtgcgctgtttcgtgcaagtgcttatggaaatcttgcgattatgtacccgatgattacaagtctttgggaagtaaaacgaattaaagaaatcgtagaagaagtaaaagcagaactaacagcagaagaaattgaatttggaaatccacagcagggaattatgattgagacaccagcagccgttatggtgagcggggagcttgcaaaagaagtcgatttctttagtattggaacaaacgatttaacacagtatacacttgcaattgaccgtcagaatccgaaattggatctgttttataatgcacatcatccagctgtgctttctatgattaagatgactgtggaaaatgcacacaaagcaggaatctgggcaggaatctgtggagaacttggagcagatacctctttgacaaaagattttctggctatgggtgtagatgaactgtctgtatcaccgggaagcatccttccgattcgaaaaatcattcttgagacaaatgttgaagaatataagagaggaaattatgctgacggagaaacgttatgaagtaatactgaaatgtctgaatgagaaaaacagtattaccgttacagaattaaaagagttacttggaatttcagaatcaacaataagaagggatttaactgcactggataaagccggaaaactggtaaaagtatttgggggagcagttgcagtggattccggatttacaaccgttgagccctctgtggctcagaaatcaggtgtaaataaagaagaaaaaagccggattgcgcagtatgcagcatctttgatttcaccaaatgagtttgtttacttagatgccggaacaacaaccggacgaatgattgaatacatcacagaaaagagcgcagtgtttgtgaccaatgctgtcagtcatgcacagcgtctggcagcagagggattcaaagttcatctgattggcggagaattaaaagggacaaccgaagctgtggtaggaaatcaggcaatcttaaatattcagagactgcatttttcaaaagccttttttggtgtaaatggaatcagcttaagggcagggttcagcactccggattacagtgaagcaatggtaaaacagaccgcactgcatcaggcgagaattgcttatgtgcttgcagattactcaaaatttggaaatgtcagttccgtgacctttgcaaatttagaagaagcggatgtgttgactgacagaaaaccaccggaaagcttttccggatgtaaaaatattctggttgtgtaaatttacgttgtttttacaacccaaatcagttattatattaagtagaagaattaattaagaaaaagatttgggggtggtaaaaaatggagcgttatgatgtatttcatgatattcttgtgaatttatttcaggagattatggatatcgaagagaaagccctgattaccgctgaatttaaaaatatatccgtgaatgatatgcatatcattgaggcaattggaacaggagaaccgaaaaatatgtcaactgtggcaaagctgatgtccgtcacggttggaacacttacaattgcgattaataatctggtaaaaaaaggttatgtaagcagagtcagaagtgaagaggacagaagagtcgtgttgattttcctgactgaaaaaggaaaacgggcgtatcagcatcatcgggagtttcatgatggaatggtaaaagcactggtggaaggtctggatgaagggcagcagaagattcttgtgaaatctttactgaatttgagaacgttttttgattcttataaaaaagattgagtgtacagaaattttgtacacccaatctttttttgctttttaatagttttccagtacatacttttctataaccggaaacggagcaggtccggtttctaatacaaatcggtgaaattcttttttatcaaatttatcaccggcttttttttcagccaagtctcttaaatccataaaattcagatatcccagatagtattttaaataattggcaggattttcaatgatgtattggtaaatttccttgcaggtatcatcagaagcaatgccgaatccatgcaaagactgtgtaacctgagctaaggtccagccgtattcatggattttaatatcgagtagagaatacaggcagagactgatggagcggttttgccataaaagctgtaaaagttctggttcgactttaaaataggaggcggcatagccgtaggaaatggattcgacataagtcgcccagccttcaatatagccactgcatccgagcagatttcggataggagcaggattttgatttccataatataaagtttgatagaggtgtcccggaaagccttcatgggcaagtgtggtaaagagttcggcaggatttacctgtgaacttcgattgatataaatggtatttggacttaaggtgtccgcaggcggagtcagataaaaggcgggactggaaaattcttccattgaggtgggaacatatttcacttcgtacttgggactgtctaaatcaggaaaatccgtctgcatggctttgtttagataggaaagcatttcttctggtgtggcagaaagagaaaaaacagaaagattttgtgcaagggatggattttgggagagcagagtctgcatctggcggtaatcaagggcaagctgggtaaaaagccgttcttcgatttcgttggtactgcgaaaatctccgacctgactttgaatcaggtagtgataataggcagtaccatctggaaaaccggcaagccctctgtcatttttttcactgccttttagagcagaaagcttttctgaaagtgattgataggaaggaatcacgcaggtatggattaatttttcatggaggcttagataggaatctgcctgttttttggtaagtgtatcagtattttgaagtgaattaatcttatctttaaaagcagaagcaagataatccgaggagagcatggtctgacactgtgtaagcaggcgctccaaagaagcatcactcataaagagcccacgcttcgctttttgagattcaaattctgccagttcgttataatagtcggggaggcaggagagtagagaaaaatagtctttgatatcgtttcctgtgcggaaggtgtattcggcaagcagaatcggaagctgggaagaaattccgagatgaggacttaagggttcttgaagccagaaaaagttttcaccggaaagctgcgtggaaaattccagagagagaatatcataagtcagctggttttctttggaaagtttttgatagtgaaagtttttcaggcgtttttgattggattttaatttagaaaatgaattagaatgagctttttcgttcattgagccaagactgattttataatccttgattccaaatttctcgggatgtgcaagcgtataatgcagatttaaagtattagaagaaagttcggaagtaaaaatagaatcggtaaagtgttcaaactgtttgttttccagagtgggttcgatttttttcaaaaagatgatagaaaaaacaagaaagaagcaaaaaatgaaaatcaagattcgatatttgttatgtaggaaatttttcaaagaactgtcctcttaaagcttgagaattctttattagtttatgaaaaaaatgaaagagtatgaatgcagataagcattcccccgcttcaagtgcgcagatcgcgaagcgactgcgttcatgagcaagtagcgaagcggattgcgaatgtctgctttaccaatacagacaaattggaaaaagcctctgctggaaaaaggcagagacttgtgataagctaatgaagaagtgaactctaaaataagggaggaaatgcaaggtgaaaaagaagatgctggttttatttctggcagtgggaatgatacttggaggatgccagaacacacaggaaaaaccacagaccggaaagggagaagaaacatcacgggacgaaacggaagacacgccagaagaagagaagaattatgatgtaaaactgtcgaagaacttatatgattttgaatttgcaataaatgatacggtttttcatttgccgcaaacgctggatgagtggaaggagactggatggtcttatgagcgtgccgagtcggaagaaatgctggatggtgattcgtttttggagggggagacattaaagaacgaggaaaaagaactgattgtggatattgtgaatctggatggagaaaaacagcagcttggcgcatgcagtgttgggggagcgacactggaaaatacggataaggataatatggtttatcaactgcctggaaaaatcacagtgggagaatccacgttagatgatgttttagatgcgtatggagacccggatgaccggtatgaggaaaaagactgggtttatgtaacctatgaatatggaatttataagaaagcggatttggtatttgacattgaagatgaagtccttgaaaaagcagtgctgaaaaattacagggattctgaaccggaagaaaccagcaaagacgtgccaaaagaagtgagtgactatcaggctccggaagctttttcagagaatccactggattttatcgtgcagtttgatggagatttttatcagcttccggcaccggtttctgaatttatcaaaaacggatggaaaatcgatgaagaaggttccgatacctcggtaaaggcaggacgccatggctatgtaacattggaaaaagacggacagacgttatatggtgttgtgaataattactctaagagtgcagttccgattaaaaatagttttcttaccaatctgcatggagattttgatgtgacaaaagtgccgattcagatttatagagggattacgcttggaatgaatgaagaaagtatgaaagaagcgttatcggatgcaaaatatgaaacaaaagaggacgaagaaggagtttcttattatctttatgcagatgaagaaaaacgggattatgtgcggatttttgtagataaaaatttaaaattggtgcgtgaaattgagctgagtaacagtccggaaggactggaagagaaaatgttatcggaagaggatgaaaaaagtgtagaggcttctgcaatgtcaggcagtgatactcttccggaacaggaataaatttaagaaagaagagataacaggtatggaagaaaaaatttatgatatggtaattatcggagcaggtccggcaggaatgagtgcggcggtttatgcaaagcgtgcagagctttctgtgctggtgattgagagagattttgcaagcggtggacagattgtaaaaacctatgaggtggataactatctggggctgccgggaatcggcggatatgagctgggtgaaaaattccgggaacacgtagataaatttgaagttccgtttgtaagagataaagtacaggaaattcagttagatggaaagcttaaaaaagtaatcacgagaaagggaggatatcttgctaagactgtgatttttgcaggaggatcaagcccgaggctgcttgagattcctggagaagaagaatttcagggaatgggtgtttcctattgtgcaacctgtgacggtgcatttttcagagagcgggtgacagcagtaatcggaggcggagattcagcagtggaagatgtgattttcctttcacgcatttgtaaaaaagtgtacatgattcacaggagagattcgttaaaagcatccaaatctctgcagtcagtccttgataaacttgaaaatgttgagattttgtgggatactgtagcagaagcgataaagggaaacagtgaggtagaaacacttcagataaagaatcagaagactcaggaaaaacgtgagctttcggtagatggagtgtttattgcagttggagcagttccgaataccaaagaatttcagaatttgattcaactcgacgaagcaggttatatcgcagcggaggaagattgtagaaccaatgttgcgggaatttatgcagcaggagatatccggacaaaggcactgcgccaggtggtgacagcggtttcagatggcgcaaatgcagtttacagtgcgcagaaatatctatctgaacttgcataagggacagggaaacacataataacacatggcaaaaagaggattaaggaggaactttttgatgaaaaacacaaaagtactggtagaagaactggaacagggaaaatatgacagcgttctcttagatttatatgtggatgcggaaaaactggactatcagagaaaacgttatattgagacaatcaaaaaatatgaggaaacattcggagaaggcgaagtggaaatctatagcgctccgggaagaagtgaagtaggtggaaaccatacagaccatcaacatggaatggtacttgcaacttctatcaatctggatgcactcgcagtagtgggagcttcaaaagacgaaaatattcatgtaatgtctgaaggatatgacatggtggatgttgagattgatgatttagaagccagacatgaagaagaaggaacaactgctgctttaatccgtggtgtaaccgcagatttaaaaggaaagggttatgaagtaaaaggatttcaggcttacgtaaccagcgatgtattgattggtgcaggactttcatcctcagcagcttttgaagtaatcgtgggaaccattctttccggtatgtttaatgacgaaaaaattgacccggtagtgattgcacagtccggtcagtttgcagaaaatgtatactttggaaagccatgcggactgatggaccagatggcatgttcagttggtggtatgattcatattgattttaaaaatccggaagagccggtagtagaaaaagtaccatctgattttgaagcttatcagtacagcttatgtattgtagatacaaaagcatctcatgcagatttgacagatgattatgcacagattccggcagatatgaaaaaagtagcgaaattctttaaaaagaatttcttaagagaagttctggaagaagaattttataaccagatttctgcaatgcgtggtctgttaggagaccgtccggtgcttcgtgcgattcattttatggaagaagaaaccagagtacagaaagaagtggattctttaaaagcaggagacttcaaaggatttcttgaactggtaaaagaatccggtaactcttcttttaaatatcttcagaatgtatatactacaaatgacttaaatcagcaggccgtttctgttgcactcgcaggaagtgagagaattttaggaaaacatggcgtgtgcagagtacatggtggtggatttgccggaacaattcaggcattcgtagaaaatgatttcgtagaagagtataagagaagaatggacaaagtatttggacatggttcttgtcaggtattaaaagtacgtcaaaaaggcggggtaaaagttctcggataagaaatataattttcagaatattcacggaaaaaaagtgcacaaaagattttaaaaagtggtcaaaatcacgaaaaatacggaaaaagttatccacattttattgtggataaaaggctgtaaaatcaagttatccacaaagttatccacattcgtgtggaaaatgtggataacttttttgatttacataagattcgagccaaacagacgttttgtgcataagttataaaagtggatttgtggataactttgtggacaaaaaaatcacgagagtcaaattcaattattggggaataaacacttaaattgtatgaaattatgagaaaactaaatataatatcagaaaataatgaaatcctataaaacttcataaaggacacaaaaaaacaccgtccccgcagtatcaagtctctgcaaaaacagtgcttttagtgcgccttcagggactcgaaccctggacaaatagattaagagtctactgctctaccaactgagctaaaagcgcattcgttattccatttctttaatgcaaaacttattatactggaataaacgaaaaaatgcaaggggaatttattgtattttttgtttttatttaaaaacatgatgccaaggtcaaaaagttcaaaaatcgttcgggcttgcacgacaagatttttgactttggggtcgcctaaacatgaaaatgtagcgatttacgtagtaaatcagcggaatttgaatgtttatagaattgcgagagctgttttacagcgaagcaattcgtaggcatcaattagagttttttagcgttttttcttcaaatattgcagcgatttctcggcttccatggcggccttcataattcgtgccgcctgtgttcccatttttcgattggtgtaagcccagatagagagtgtggtctgtaaagatttcttttttgacaaagcaaagattcctttttatttaagtatatgaaaagaaatcttatcttgctgcaattaatttacagattggatttccctcagaagagaatttttcttcgtattcggtcataatattaccgacattcattttttcgttgtgatggaggtcgtaagtccattcgaccagatgccatttgctttcattgacttcctctaaagagaaatcaaagagcgggcgattgtcggtcttaaattcaatgactccgtctgattttaagattgcatcatagcgttctaaaaactgacgtgaagtaagacggcgtttagcatggcgttcttttggccatgggtctgaaaagttcagataaattttatcgacttcccctgcgtcaaaaatgagtggaagttctcttgcgtccatgcggacaaagtaaacatttggaagagtgtttccattttcggcacgttcttctattttttgaagagcacgtagaagaacactgtcgtacatttcaaatccgatatagttgatatccggattctgggaagcaagatccattaaaaaacgtccctttcccattccaacttcaatgtgaattggatgattgtttttaaagatttcattccaacgacctttattttgtgccggttcgtgaatgacataaggactgctttcgatggcatcttttgctcctggaatatttcttaaacgcatatttcgttccagcctttctatttatgtgattgatatctgatacagtatactgaatctgaaattgtttgtcaaagcctactcgtcaaaacggaagaaagatgtgggaaaatagacagaaaaggcaggaaaggtttagaaaaattgcataatttaatagaaactttatgaaaaaatctatggattttttctgaaaatagtgtatgataggagacaagtagtagaatatagttaaaaaatagtttaacttaagatttcacttaaaacaaggaggagcttgcatggatgatgtaattagtaagctggcagaaatagaattggctgcctccaaaataatggaaaatgtggtggaggagaaaaaaagcctttctttagaaaatgaagccaggataaaagcctttgatgatgaggtggacaaaaagacagaagaaaaattggaggggatacgaaaagggcttgaagtggatatggagcaggaactgcttttacagaaacagcagacggaggcaaccttaaaaaaaatggaagccggatacgaacagcgtgccgaggcaatggtgcaggagttatacgacaaaatattaaggatgtgatattatgggaactctgttatcttacagtggtctttcaacaaaaatccgagcgatgcagagccggctgatgacagaaaaacaatatcaggaaatcgcacagatggaatccgtgacacaggtagttgcatatttaaaaagacagcctggatttgcaaagctgtgggcggatctcgatgaaagcagtctgcatcgtggagagattgaaaaacttctgacccataccatccatcaaaattttgcgaagatttaccggttcgcaaatccatcgcagagaacctttatggatttgtattttaaacgatatgaaattgcggttatgaaggactgtctgagaaaaatctttgatggaagtggagatggacttgatttatcactgtttcaggatttctttgataaacattccaaattaaatttagagaaactgaccaaatcagcgacggttgaagaatttgtttctaatttaaaaggaacagagtattatgcaccgctttcaaggattggacaggagtatcatccattgttgtttgattatggaatggcgcttgaccagtattattttgcaaatatctggagaatgaaagataaactgtttaagaagagagatttagaagagattataaaggcttatggtaataaatttgatatgttaaatctgcagtggatttatcgttccaagaaatattaccacatggcaccggcagatatttatgcgttgctcagtccggtgcgttacaaactttcaacaaaagaaattacagaacttgtagaagctgtggatgaggaggagtttcgcagggtacttgatactacggcatataaaaagcattatccggaactgacacctgataagctggaagaatattataatttcagcatgaggacgattttagagacggaagcaagaaagtatccacattctgtaatcatgatatattcctacttttatcataaggagcatgaggtggatcggctgacaacagcaatcgagtgtatccgctatggtttggctccggctgagacattggaatatattcatagaaattaaaccggaggtagcagacatgattgagaaaatgaagttcttaagcattactggtccgaaggctgatattgaccgagtggttaaccaatatctggcaaaatatgagattcatctggaaaatgcaatggcacagctgaatcaggtacaaaacctgtctccttttatacagattaatccgtataaagaggtgcttgcaaaagcagaagaatttacgggacttcttggagaggaaaaacagctgaaattacgagatatctctttagaagaagccacggaattgattgacagacttggaagtgagctgtcggaaattaatgtaaagtgtgaagaagaaaacaaaaaacgaacgaaaatagtagaagatttaaatctggtcagtccgtttttaaaacttccaggcgatattgaccagctggtgcattatcgttttgtgcaggtgaggtttggaagaattgccagagaatactatgaaaagtttaaggcttatgtatatgatagtctggacacttggttttatccgtgccacgaagatgagtatgtgtggggtgtttattttgtgccgtggaccaggatggaagaagtcgatgcagttttttcttctctgcattttgaacgaatttatttaaagaaagattattactatggaactccacaggaaatctacgataagttaagggtagagttaaatgcagtagataagaaaattgcagaatataagagccaggcttctgaattgttgaaaaaagatgcagtatctgttttttctgcaaaagagaaattaagtgcactgtcggttaactttgatgtacgtaaagtggcggcctgcgtaaaagagcatcacgaaacgttttatattttatgcggatggatggcggaagaagattctatcgcatttgcaaaagaaattgaaaatgatgcaaatctgttttgtattattgaagatgataagtataacatcaatgttcaaccgcctacaaaactgaaaaatccgaagatatttaagccatttgaaatgtatattaagatgtatggacttcccgcctacaacgagatggacccaacaatctttgtggcaattacctattcctttatttttggggcgatgttcggagatgtcggacagggattattattagcaatcggtggactcatcctttataaagttaaaaacatggatttggcagcgattatcggctgtgcaggtgtgttctctacgatatttggttttatgtatggaagtttttttggatttgaggatttaatccccgccttgtggctgaaaccatcggaggcaatgctgttgataccgggtcttggaaatatgaatacggtattcgtagttgcaattgtatttggtatgttcctgattctgcttacgatgatatttaacattatcaatgcagtaagaagtcgagatatcgaaaatataattttcagccagaatgcaatctgtggattggtattttatggcgcattgaccgttacgattttactttatatcacaggacatgcacttccggcaacagtagtattagttgtaatgtttgtaattcctctgattttaattatgttaaaagagccgttgacccgtattgtggaaaagaaaacaccggcaattgagggcggaaaagcaatgtattttgttcaaagtttctttgagttgtttgaggtaatgttaagttatctctcgaatacactttctttcgtgcgtgtgggggcatttgcagtcagccatgccgcaatgatgggagttgtattgatgcttgcgggagcagagagcggaggcagtatcaactggctgattattattcttggaaatgcatttgtatgtgctatggaaggtctgattgtaggaattcaggttcttcgtctggaatattatgaaatgttcagccgcttttataagggcagtggacgtgaatttaagccatttttaaaaaatgtaaaaacaaatcattaagtaaaaacaaatcattaagtaaaaacagaagcgagagcaaggaggacttttattatgacaggtattattcaaattacaattgcagcagcattaattttaagcattattcttccatttggagcattttttcttggagagaaaaacagaaaacgttataaaacatctcttggggtgaattgtttctttttctttggaaccttacttgtggcaactgttgttatgcttggcggaacagtgacagcaaacgcagcatctgacgcagcagcatctggtcttgcaaccggtcttggctacatcggtgcagcactcgttaccggtctttccggtatcggttccggtattgcggtagcaagttcagcaagtgcagcacttggagcaatcagcgaagatggttctttatttggtaaatctatgattttcgtagccatggcagaaggtattgcactttatggtctgattatttctttcatgattttaggacgtcttggttaaattggactaaaaacagcggcaggatagaatgggaaaggagcgggcatttatgaaaatgtttttaatcagtgataatattgacacctacaccggtatgagactggcaggagtagagggtgttgtggtacatgagcgggaggaacttagaagggcactggaagatgctatcgcaaataaggaaaatggcattattcttctgactgagaagtttggccgtgaatttccggaaatcattgatgatgtgcgtctgaaccatcgcctgccgcttcttgttgagattccggacagacatggtaccggaagagcagaagattttattttatcttatgtaaatgaagcaatcggtctaaaattataaatgattcagaaataagaaggtgatggacatgacaacggaagaaaaactgcagcatttttatgatgtatcgatggagagtgccagggaagaagcacagaaggcacttgaagaatatagaagggcacttgatgatatgtttgaagaacataaaaaagaaaaagaaaaaagtgccgagcttcgtctgaaactggaaacggaaaatgcaaagcgtgaaattaataaagcattatctgcagagcagcttcacattaaacgaaaactgtcaaagaaacagcaggagttaagagaaaaaatttttattgatctgcaggcaaagctggaaatttttcgtaagagcagtgattatccaaagtggcttgaggaaaagataaaagaagcacaaaacattgcagattcagatgagattcagatttatttatcaaaaatagatgaaaatttaaaagaaagtatagaggcagaaacagggatttccattcaactttcagaagaaccgtttatgggaggaatgagagcagtgattcctgcgaagaatatactgattgaccagacatttttaacaatgtttgaaagtgaaaaagaagaatttaattttgacggagggctgctaaatgagtagaacaggaatcatatatggaattaatggccccgtcatttacctgaaaggaaataccggatttaagatgtccgaaatggtttatgtgggagaagaacatctggtaggagaggtcattgcgctgacaaaagatacaacgactgttcaggtctttgaggagacaagtggattaaaacccggagaaacggtaactgcaaccggagatgctatttcagtcacattaggacctggaattttagacaatatttttgatggtattcagcgtccgctttctgttattgcagaacagtccggaaaatatatttccagagggatgcaggttgattcgctggatacagagaaaaaatggaatgtaaaatttctggtaaaagagggtgatgaagtccacggaggaaccatttttgcacagacacaggaaacggcttcgattatgcataagtccatggtacctccgaaagtagaaggaaagattaagaaaattcttccaaatggggaatatagtgtaagcgaaatccttgcggtagtggaacaaacagacggaagtgaatatccattgaagcttgcccagaaatggccgattcgtattccgagaccgacaagcaaacgatatccggcaacggttccgcttgtcaccggacagcgaattttggatacgttgtttccgattgcaaaaggcggaacagcggcagtacctggaggatttggaacaggaaagacgatgacccagcatcagattgcaaagtggtccgatgcagacattattgtatatattggatgtggagaacgtggaaatgaaatgactcaggttttggaggatttctcaaaactgcatgacccaaaaacgggaaatgcactgatggcacgtaccaccctgattgcgaacacttcaaacatgccggttgcagcacgtgaagcttctatttataccggaatcacgcttgctgaatattaccgtgatatgggatacgatgtggcaatcatggcggattccacttcaagatgggcagaggcacttcgagagctgtccggacgactggaagaaatgccggcagaggaggggttccctgcttatctggcatcaagactgtctgcattctatgaaagagccggcatgatgcagaacttaaatggaacagaaggttcggtatcaattatcggagcggtttctcctcagggcggtgacttctctgaaccggttacacaaaatacaaaacgatttgtgcgctgtttctggggattggataaatcccttgcttatgcaagacactttccggcaatccactggctgaccagttacagtgagtatttaaatgatttggcacactggtatggagaacatgtttcacccaaatttgtggatgacagaaataaattaatggcaattttgaatcaggaaagcagtctgatggaaattgtaaaattgattggtagtgatgtacttccggacgaccagaagctgacccttgagattgcaagagtgattcgtcttggatttttacagcagaatgcatttcatccggatgatacctgtgtttctctggagaagcagtttaagatgatggaaattattttgtatttaaatcaaaaatgcagaagtctgattgcaatggggatgccgatgtctgtacttcgtcgggaaaacatttttgaaaaagtaatctctattaaatatgatgtaccaaacgataagttagagatgatggatgattatcaaaaagcagtagatgatttctatgatacagtcatggaaaagaatggataaggagggaacggaatggcaatcgaatatcttggcttaagtgaaatcaacggccctctggttgtgctcgaaggggtgcaggatgcagcctttgatgaaattgtagaatttaaagtagatgacggtacaaaaaaaatcgggcgtattgtagaaatttatgaggataaagctgtcattcaggtatttgaaggaacagaaaacatgtctctgttaaacacccatacaaaattgaccggacatccgatggaagtagaattatctccggacatccttgggcgaacctttaacggaatcggaaaaccaattgacgatcttggcccggtgattccggaaatgaaattaaatattaatggtctgccgttaaatccggtcaaacgagagtatccgagaaacttcattcagacaggtatctctgcgattgatggtttgacaaccctgattcgtggacagaaacttccgattttctcaggaaacggacttccacatgatcagcttgcagcacagattgtaaaacaggcttctcttggtggggacagtgatgagaaatttgcaattgtatttgcggcaatgggcgtaaaatatgatgtagcagaatttttccgcagaacttttgaggagagcggtgttgcggaccacgtagtcatgtatctgaatctggcaaatgacccagtagtagagcgattgattacaccaaaggttgcacttactgcggcagagtatctggcatttgagaaaggcatgcacattctggtcattcttactgatattacttcttttgcggaagcgatgcgagaggtttcttcttcaaaaggagagattccatcaagaaaaggttatccgggttatttgtacagtgaactggcaaccctttatgaacgtgcaggaattgtaagaggtggaacaggttcggttacacagattccgattcttacaatgccaaatgatgatattacgcatccaatccctgacttaaccgggtatattacagaaggtcagattgtactcgagcgtcagcttcatgggcaggcaatttatccgccgattaatgtccttccatccctgtctcgtctgatgaaggatggtatcggtgaaggttatacgagagaagaccatcaggatgtagcaaaccagctgttttcctgttatgcaaaagtaggagatgccagagcacttgcatctgttattggtgaagatgaactttcaccgctcgataaaaaatatctggaatttggaaatgcatttgaacaacagtttgtcggtcagggaccggatgaaaacagaagtattcaggaaaccctggatctcggatggaaactgcttggaatgattccaagagatgagctcgaccgtattgacacgaagatactggataaatactatcatccggaagagaatgcataaagaagaggtgatgttatggatccgaatacctttccaaccaaaggaaatctgatactggcaaaaaattctctcgctttatccaaacagggctttgatttgatggacaaaaaaagaaatattttaattaaagaactgatggagttagtagaccaggcaaaagatatccagtcacagattgatgtcacatttcgtacggcttattcggcacttcagagagcaaatttggatattggaatcagctatgtacaggaaatttcaagaactgttccggtggaagattcgattcagattaagacccgaagtgttatgggaacagagattccattagttcaggcgaatgagtcatccaatgcgccaacttatgcttattatggaacaaaggcttctcttgatgaagcaaagtcagcgtttgaaaaagtaaaacagctgacgattcgtctttctgcggtggaaaatgcagcctatcgtctggcaattaatattaagaaaacccagaaaagagccaatgcgctgaagaatatcacaattccgaaatatgaagaattgacaaaatccatcagcaatgcactcgaagaaaaagagagagaagaatttacaaggttaaaagtaattaaacgaatgcagggaaaataaaaaacataatttttatagaagagaagttgttaaaagaggaattttaacaacttctttttttaccaaaatttaacatgagacagattttatattttactttgcttttttatactgagactcgtaaatgagagcaatactaaaaaagataaaaattataaagcaaggagaatttaattatgaagaaaaaattagcagcattattaattacaggaattatggcagcagcaatgacagcatgtggaagcagtaattcaggaacagacaacagtggaagtacagatggaactgcaaaaacagagagcagtgccgatgcgggcagtgactgggataatacaagagacatcacagttgtatcaagagaagatggttctggtacaagaggggctttcgtagaattattcggaattgaagaagaagtaaacggagaaaaagtagatatgacaacagaagaagcaaatatcacaaacagtacttctgttatgatgtctaccgtggcacaggatgaatacgcaattggttatatctcgctcggttctttagatgattccgtaaaagcagttaaagttgatggaagcgaagcaacagcagaaaacatcaaaaatggaagttataaaatttccagaccgtttaacattgcaacaaaagaggatttaagtgacgcagcacaggattttgaagactttattttaagtacagaaggacagaaagtagtggaagacaacaaatacatccctcttgatgatgtgagtgattataaatcaaatggagcaagcggaaaagttgttgttgcaggttcttcttctgtatctcctgtaatggaaaaattaaaagaagcttatcaggcagttaacagtgatgtagaagtagaaatccagacaagtgattctacaacaggtatgcagaatgcaattgatggtgtatgtgatatcggaatggcttccagagaattaaaagattctgaaaaagaagcaggtctgacaccaactgttattgcaatggatggtattgcagtagtcgtaaacaatgataacccgactgatgaactgagttctgatcaggtaaaatccatctttacaggtgatgtgcttacatgggatgaggcgcttcagtaaagaagacttaagaaagaatcagtagcctgaagaaggttaaaagggtgaacagaatgaaaaaatataaagaacaggtgatgcatgcggtgttttttatcgccgcatgtgcatccgtacttgcagtcgctttgatttgtctgtttttgtttgtaaacggaattccggcgatgaaagaaattggaattttcaagtttcttttaggaacgatgtggaaaccgggaaataatatttacggaatccttccgatgattatgggaagtatttatgtaaccgcaggtgcaattttaatcggagttccgattggaattttaacttctgtatttatggcttcctactgtccaaaaaaagtatatcgtttttttaaatcggcaattgacttattggccggaatcccatcggttgtatatggtttctttggtttaatgatgttagttccactgattcgcaatttattccacaaaggaaacggaagcagtattttaagtgcttctatcctgcttggaatcatgattcttccgacgattatcggggtgacggaatctgcaatccgtgcagtaccttccaattactatgaaggttctctggcacttggcgcaacaaaagaaagaagtctgtttttcgttgtgcttccggctgccaaatccggtctgattgcaggtgtggtacttggaatcggtcgtgcaatcggtgaaactatggcagttgtaatggtagcaggaaatcaggcacgtatgcctgccggaatcttaagaggtgtccgaaccatgacatcaaacattgtactggaaatgggatatgcagcagatttacacagagaagcattaatcgcaacaggcgtggtattatttgtatttatcttaattattaacttctgcgttgccagattaaataagggggaaagtggtcatgcataaaaaagaacatcagggagcgaaaatcagtgccggtattttaaaaggtctggtctttgcatcagccgctttaacctttttagtcttatttttcctgattgtctatattttggttcatggaattccgaatctgacaccacagttatttgcatggaaatatacaagtgaaaatgcttccatgcttccatctatcattaatacgttaattattgtgatattatcactggtcattgcagtgccgcttggtattttttccgcaatctaccttgtggaatatgcaaaaagaggaaataaatttgtaaaaattattcgtctgacgacagagacactttccggaattccatctatcgtatatggtctgttcggtgcattgttttttgtaaccgcattaaaatggggttattctttacttgcaggtgctctgacattgtcaattatgattcttccgctgattatgagaacgacggaagaagcattaaaatccgttccggattcctttcgtgaaggaagtttcggacttggagcaggaaaactcagaacggtatttcaaattgtacttccaagtgcaattcccggtattttagccggtgttattcttgcagtcggacgaatcattggagaaacagcagctttgatttataccgcaggtgcggtggcagaagtgccgtcgagcatcatgggttctggttcaactttagcagtacacatgtacaatctttccagagaaggtttatatatgaatcaggcgtatgcagtatccgttgtcctgttaatttttgttctgctgattaactggggttccggaaaaatagcaaagaaacttacgaaagggaaagaataacggaaatggaattgaaaaaaaatcagaaaatagaagtctcaaatctggatttgtattattcagattttaaggcattaaaaaatataaatattaagattccgcaaaatgaaattacagcatttatcggaccgtccggatgtggaaaatcgacgcttttgaaatcattaaatcgtatgaatgatttggtagaaggatgccggattgatggacaggttttgctggatggagaagatatttacggaaggatggatgtcaatctgcttagaaaacgtgtcggaatggtatttcagaagccaaatccatttccaatgagtatttacgataacattgcttatggaccgcgcactcatggaatccgttccaaatccaaactggatgatatcgtagaaaaatccctgcgtgatgctgccatctgggaagagacaaagaatcgtttaaaatccaatgcacttggaatgtccggtggacaacagcagagactttgcattgcaagagcacttgcagttcagccggaagtacttttaatggacgagccgaccagtgcccttgatccaatttcaacttccaaaatcgaagaactggcaatggaattaaagaaagagtatacaattgtaatggttacgcataacatgcagcaggcagcccgtatttctgataaaactgcatttttccttttaggggaaatcgtagaatttggtgaaacagaacaattattctctatgccgaaagataagagaacagaggattatattacagggaggtttggttgatatgcgtacaagatttgaccagcaattggaaaaactgcatgtggaattaattaaaatgggaagtttatgcgagcaggcaatcacactggctgcgtcttctttagaagttcaggaagagaatactttgcataaagtggcagcacttgagagtgaagtagatgcaaaagaaagagaaattgaagatatctgtatgagacttctgcttcagcaacagccggtagcaagagatttacgtgttatctcggctgccttaaaactgatttctgatttggaaagaatcggcgaccaggcggcagatatttctgacttgactccttatattgtaaacagcagtattgcgagtaaagttcagattcatgatatggcaaaggcaacgattgacatggtaacaaaaagcattgatgcgtttgtaaaaaatgatttggagcttgcagaaaaagttattgaatcagatgatatcgtagatgatttatttaataaaataagagaagaactgattcaggaaattcagggaaaaaacaatgacccaagagcggcaattgatattttaatggcagcaaaatattttgagagaattggcgaccacgcagttaatgttgcagaatgggtacagtattctattaccggtgtgcataagagtaatgaacatcatatagcagacagataggaatgaggtgaaagggttggtctatctggtagaggatgatgaaaatataagagaactggtcacatacacattaaacagtcaggggattgaaacagaaagctttgaacgcccatctaaattttggaaggcaatgcagcaggagattccatccctgtttttgcttgatattatgctgccggaagaggatggacttagtattttgaagaaaattaaaaatacaagccagaccaaaaaattgcctgttattatgctgactgcaaagggaagcgaatatgatacagtattaggtctcgacagtggagcggatgattatatcgcaaagccgtttcgtatgatggaactgatttcacgagtgcgtgctgcattaaggcgaagcgatccggaggaacaggaaagggtcaaagaatatcagtttggaaaaatctatgtttgtccatccagacatattgtgagtgtggacggaaaagaaatttcacttactttaaaagaatttgaactgctgtgcgtactgctttctgaacaggaaactgtattttcaaggtcaaaattgttagaccgtatctggggctatgaatttgatggggaaagcagaacggtagatgttcatgtgcggacactcaggcaaaagctgggagatgccggagactgtattaaaacagtaagaggagtaggatataagataggaggaaaagcttcatgacaaaacggattttccgctcaattatgctggtttctgcagtctgcatggtgacaggactggcatttcttatgggcgttttatatcatttttttgggaatcaattagaaaaagaattaaaagcagaagcatcttatctggaacttgcagtagaggaaaatggagagagtgtacttgagaagcttccaaaaaattcggcaagggtgacctggattgcggaggatggaacggttatttttgataataaagcagacgcttttgatatgtcgaatcacaatgacagggaagaaattaaggatgcacagaaaaacggtgcaggaacttctgtcagacagtctgatacattaggagaaaagacggtctactatgcaaaacgtttgtctgataatagtatccttcgtatttcgagcgatcagtatacggtgattgctctgttaaaacagctgattctcccagctgtctgcgtgctggttcttatgatattattaggagcattttttgcatcgagactttccaaacatatcgtaacaccattaaatgagctggatttggaacatccggatgaaattgatacttatgatgaaatggctccatttattacaaagattaataaacagcagaagaccattcagaaacagctttcggatgcaaaacgacagcagaaagaatttcagattatcacaaagcagatgcaggagggacttcttgtcatcgatacacagacagatttgctttccagtaatgccagtgcactggaacttttagatgccggacaggtaaaagataaagaaagtgtgctgtcactgaatcgtagtgaagcatttgagaagacaatagacaaagtcttacgtggagaacatgtagagtccgtattaaatttgggagaacgttactgccaggtttgtgcaaatccggtatttgacaaagaaacgatagcaggtgcagtgattcttttaattgatgtgactgaaaaaatgcagagagattctttaagacgggaatttacagcaaatgtctctcatgaattaaagactccgttgacttcgatttcaggctttgcagaaatcattcaaagtggttttgtaaaacaggaagatgttcggaagtttgcaggaaagatatttgatgagacacagagactggttaccttagtggatgatattataaaaatttctcagctggatgaaaattgtcagccgtatcagagagagaaagtagatatctataatctggctaaagatgtattgagcaggcttcaggaatctgctaataaagcacaggttcagttgaatatggaaggtgaacatgcagaacttgaaaccgtactgccgattttagatgaaattgtttctaatctgtgtgataatgcgattaaatacaataaaaaaggcggaagtgttaccgttacggtattaaatacaagaaatcagatatgcctgtctgtctgtgataccggaattggaatcacagcggcggaaaagagcagagtatttgaacgattttatcgtgtggataaaagtcattcaaaagaaattggtggaaccggtcttggactttcgattgtaaaacacggtgctgcttatctgggagcaaaagtagaactggaaagtaccattaataagggaagtacattccgtctgatttggcaaaaataaaagaaaaagaccttttgaacattgttcagaggtcttttttgaattgaaaattagtattttgaattttattttgaattagaaattactgcatcatacctgcaagtacctgatttaccagtttgccatctgcaattccttttacttttggcatcaggactttcatgatgcgtcctttatcttttccggttggtgtttcaatttcaagttcttttaaaactccatcgattactgttttgatttcgtcttcatttaacatttttggtgcaaattcttcgtatacggcgatgcgtttgctgcattcttcgataatatcagttctgtcagcaggagtcatttctaaggtttcttttgtctgtttgatttcttttaagacaacttcattttcttctgcttctgttaaatcttctcttttatcaattgctttgtttttcagtgcggataagagcatggacagagagtcttttctttctttgtcttttgctttcatcgcagctaccattgcttttcttacttcatctgctttactcatagtggttatcgctccttttcaaaatattttctaatttaagagtataacactctgaaaaaaagaatgaaacccctaattagcggattctccataaattccaatgaaaataggaagcgaggagacggatgacgacagtcacaatcaagccgataattgcaccggcggcttcaccgacagagtttcggcatatcacacaggcagcacctccggcaatggaagcgcaggcataaatttcccgaaccagaatataaggggtttcgcctgccatgatatcacgaactacaccacccccgaccccggtcaatactccgacaaaaacaaagaaaaaggcattgtctttgttcataacatttgcggcagcctgaatcccgactacagtaaagattccaagtccgagcgtatcacataaaagcatgatggtatcgtaatatttacttttaaacccagaatctaagatagaaggattggtgtagacaattgtaaacagcagggtagcagtcagcaccgaaaataacacatataccggtttggaaaatgcagcaggaggagtgacgccgagaataatatcacgcatcattccgccaccgacggcggtagtcgctcctaaaatgtttacgccaaaaatatccatttttttttcgatggcgatcattgcacctgaagatgcaaatgcaattgtgccgataatttcaagaataaaggtaaaagtatccatagatgtcctcccaacaaagacttttgtgagtgagaaaaagtctttgaaaaattgtagaataattaatattgtattagtacaacaaagcagtttcagtatagcataaagacgtaaaaaaaacatctttaaatggcacaaagtccgtgaattacggacgttaaaagatttgactttttatggattttttgttactctatttaagactataaagtgtaaaattgtgaagttggaaaggggaaaaatggagaaacataaaaatgggagctttacaagctcaattggttttgtattggcctgtgtaggttcagcagtcggtctgggaaatatctggatgtttccatatcgtcttggagagtatggcggagcagcatttttaattccgtatctgttttttattctgttgtttggatttgtcgggttatccgcagaatttgcatcaggaagaaaagtaggaacaggaacgcttggggtgtacgcttattgttttaaagaaagaaaacaggaaaaacttggaaaaattttaggctggattccgcttatgggttcacttggaattgcaatcggatattcgattattattggatgggtcttaagatatttaggtgcgtcagtaaccaataccgtgctgaaagaggattccgcagaattttttgccggagttaccgcatccatgaaaaacgttccgtggcatatgatgattgtggcgattacggttatcattttattagtaggagccgcatctcagattgaacgggcaaataaagtactgatgccgttattttttattttatttgcgggacttgcagtgcgtgtctttttcttagagggttcacatgagggataccgtttcttatttgtgccgaactggaaagcacttttaaatgtaaatacctgggttatggcgatgggacaggcatttttctcattgtcgattacaggttcaggaatgattgtgtatggttcttatctgccaaagaatgaggatattgtaaaatcttctttacagacacttatctttgatacaattgcggcactgcttgcagcgcttgctattatgccggcggtgtttgcctttggaattgagccatccgcaggaccatctttaatgtttattactttgccaaatgtatttaaacagatgccgatgggaagactattctcagttctcttcttcttatccgtctgctttgccggaattacttctctgattaatatgtttgaggcagtaattgagagctggcaaaatcgttttaaaatcgggagaacaaaatctgttttgctttgtggcgcaattacatttttaatcgggttattattggaagaagaaaccagagttggaaactggatggattttattaccattatcattgttccgtttggtgcagtactgggtgcaatttctatttattatgtattaggttttgataaaataaaagaagaactggaacttggaagaaagaagccacttccggtaatatttaaaccggtggcaaaatatgtgtatgttccgctttctatcattatctttattttgggattaatttataaaggtattggataattttgttgacaaaaattatcaattataaagttgccctttaattttgcctatgctataataggcgcagacagcaaatgaagaaagacagctgtggatactttgaaaacgaaaaataaaatttctactaaacaaaaggagagtacgtcatggatgcaaaagaatttgctttaaaacagcacgaggaatggagcggtaaaattgaagttgtcagccgtgcaaaactggagacaccagaagacctttctgtagcttatacaccaggtgttgcagaaccgtgcctgaaaattgcagaagatgttgatttatcttataaatatacaagacgtcataacatggtagctgttgtgacagacggaagcgcagttcttggactcggaaacattggaccggaagcaggtatgcctgttatggaaggaaaatgtgttttatttaaggcatttgctgatgtggatgctttcccgttatgtgtaagaagtaacgatgtagatgaaattgtaaatactgttcgtttactggctggaagttttggtggtgtcaatctggaagatatctccgctcctcgatgctttgaaattgaaagaaaattaaaagagtgctgtgatattccgattttccatgatgaccagcatggtacagcagttgtaacagcagcagcattaattaatgcgttaaaattgacaggaaagaaattggatgaagtaaaagttgttacttcaggtgctggtgcagcaggaatcgcaatcattaaactgttagtaagccttggattaaaacgagtaatcatgtgcgacagaaaaggtgcgatttatgaaggtcgtgagggcttaaatgcagaaaaacaggaaatggcaaaaatctgcaatctggataaagaaaaaggaagtcttgaagaagtaatcaaaggcgctgatgtatttatcggtgtatctgcgccgggtgcggtaacagaagaaatggtgaaatccatggctgaaaaaccaatcctcttcccgatggcaaatccggtaccggaaattatgcctgaccttgcgaaaaaagcaggtgcagcagttgtcggaacaggaagaagtgacttcccgaaccagattaataacgtacttgctttccctggaattttccgtggcgcattagatgtcagagcaaaagacattaacgatgagatgaaagttgcagcagcttatgcaatcgcaggactggttgatgagaaagatcttgcagaagattacattattccaaatccatttgataaacgagttgcaaaagtggtatctgaagcagttgcaaaagcagcaagagatactggtgtgaatcgtatctaatgattacagaattgcacgaactgtattacagtaaggcaattcgtggtatcatttgagtgaattatcagaatgaaatacaaaagagaactttacgtggacagaggcgcataaagttctctttttatttttttagaactttgctataatgagatgtgagttgcaaaagcaggtatataataattttgatagtacatagaaatcgaagggggaaatttatgaatcaggaagaacgggcaagactggaagagagacaacgccagaaaaaaatcagagaacgtcgtcgaaaaaaacaggttaggagacaaaaaatgttgctggctggcattattatgataattgttataataacagcaggggtaaatattgtaaaaaataaccgtaagaaagcagaacaggctgctgtgacaaaagcaaagcaggaaaaactggcaaaacagaaacaagaagaattagaaaaagaaaatacactgtctatgattgcggttggcgataatctgtatcacgatgctattttagaagaaggaaaaacagattcgggagcctggaattttgattttctgtatcaaaacgtaaaaaaagaaattgaagaggcggatctttcggcagtgaatcaggaaacagtttttgtgaataatcatgatgaagttgccggatatccggagtttgcttccccgcttgaaggtggagatgcgctgataaaagctggatttaacattgtgacacaggcaagtaatcatgcttatgataaaggaaaagccggaatcttaaattctgtaacattctggcgaaccagtcatccaaatgttactctgcttggaatccataaagatcagcaggatgaggagcgcaatcgtatacaggtagtagaaaagaaaaattttaaaattgcgatgatgaattatacatttggcttaaatgaggcaacccctcttccggaggatgaaagttattcgattgatgtatttgatgaagaacaggtcgcaaaagatattgaaaccgcaaagtcggaaagtgatgttgtaattgtatttttacataccggtgtggaagatacgacggatattgatgaggatacagaaaatcgaattgattttcttgccagtcagggtgttgatattacgatttgttcccatccacatgtaatacgtgcctttggcatgaaagaaagagcagatggcggtcagatgctggtgtattattcacttggaaattttgtgtctacgcaggaagcaattccggagttgttagaaggcatggcaaaatttacattgaagaaagatttagatacaggaaaagtaacggtttctgattattcaatgcagccacttgtcatgcactatgatactggaaagacaaactgtgcagtttataaactttcggattatacagaggaacttgccaaagcacatggaattcatgaatattctgaagaggaatttacgttagaaagtattcaggagttttttgctccatttctgactccccagacatttgcgtcgggaagccagaaaaatagtgactaattaatcgtcgcagtattgttctggtgaaaatggatagagacttttataggaatccagttcatcagaagagacaggagcacgataaatcagaccggtcatttctgtggtggcaagaccgtcaaagtcatgtctggagctgaactctacattgtatttatcagaaataaaatcaggtgaatgatttttaaaattagaattcatggcaggcatcctttctgctttcattgaaatttaaagtgagttcgtttatactttagtatatgtaaagaaatgaatttgtaagcaacaaaaacgaggaaagtaaaaatggcaaaacataaggacaaagaagtaaaaacaaacgcaatgagaattttggacaaaaacaaaattttttatgaaacaattaattatgagtgcgatgaatttatcgatgggcttcataccgcagaaaagaccggtgcaccagtggaacagtcttttaaaactctggtagcgcagggaaaaagcaaagagtattatgtgctggtcattccgattgcagaagaagtagatttaaagaaagcagcaaaagtgctgggcgaaaaatcaatcgaaatgattcatgtaaaagatattacaaaagtaacaggttatgttcgtggaggatgcagtccgcttggtatgaaaaagctatatccgacgattattcaggaaagtgccgaaacctttgacatgatttatgtcagtgggggaaggattgggtctacaataaaagtaaatccgcaggaactggcaagggtagtaaatgcgaaatttgcagattttatcgtttgttaagattaatctgtgagtcatgaaagataagatctacttcgctgatttgaatcttatcgttatcacaaagctgatattcttcctgaggagaaagtggtttaccgtttataaaagttccgtttttggaatttaaatccataatgaaaaagcaggcggcatcttttcggattctggcatgcagacggctgacagttggaatagagaggcagagaccggcaagttcaggatgttttccgataagcagaaattcttccgttaagaaaacggtgaggggctgtccattttcaaaaacagtcagagaggcagatggtgtttgggcagagttgtctggttgaagcagtactgtgtcggaagaacaggcgggagattgagggtttggcatttgaggcgtagaagcttcaaaatcagaagaaaaatttgagttggaagaacttggattagaagaaaaacctgaatcagaggagaaatctaaatcagaggagaaatctgaattagaagaggagtttgaatgggaaaagaagtctgaagcaaaattaaaaattgactcagacttctttttttgatgtcttgaagtaaggaaaaagataagaagagaacctccaccaagaagaataaaaagaaggaaattgaggatggcctgagaaatagaaatcagacgatagtgcaggcagaaatagatacagacaaaaaaggcggaaagtgaaagtaaaatcccaatcagccacccgacagaagttttttcgtgcaaggtctcttcttcaaaaaaggacgtcatgacgtcttgtgaaggggaatcttcatcatagggatggagattctgtttttgaaaaacatttgagtgatagaggttttgagcatcaggttctttagattttaattttgcaagtgcggtttttaagagagcaggacaaagtggtgactcaaggctgtctttgtacagtccatagcctaaaagtacggcattgttatcttcatggttaattttaggcagaagatattcggttaaagagataaaatctttatcagacgaagctggttcaagtggaaaacagcaaaaataaaaagaagattcaaaatcctgataaatgtaatcgggagaaagaagcaggaggtcagcgtcaagcagataatcctccatgcaggtaattgtatttaaaagtgcttcaaataaagctttcaagtcgttagaattgaatttttttgtttcatatatttgagacagactttgccgtgaagtaatttcatagtaaagagaagtttctccatcaatcagacgagggatgcatggtaacagtcctttaattgaattggaaaacagcatctttgcagggtaatcggataatgcctgttgattttcattttttaaaataagatagctgtgattgagttcacgtttataagaaatatccatattttttttatctcctgaataaaaattttagagttaaagttatttcattgcgagtcggtagctgagtgtggggatatggaatatcccggtgtgattttattgggaattgctaccggaaatattgcacaatgcctgagcttttttgattttttcaataaaaagaaccggttgtatcactttagaatgggatgtgcctttgatgtgccagtttaagttaaaaattggaaaacggaattgttcttcaaaggaaacaaggacttcatggttgcttccggaaacagaataaccacctgtttcccagtggattctgagatttgcagtagagagcccgtcttgattctttctgacagactgtatgcttccaagttcagaagcttcaagagatgcatttgtacggatgctatgatgaagtgttccaattattaaaaaaagagaggcaaaaataaccagtagaaataaaccgcttaaacaggcagcttctacggtataactgccacgaagttttaactttgtcatgtcaattcctccttaaaccgattgggaaaaaaacagattcaggaacatgccggccagtaaaaatggaataaaggggatggtttcagtgcggttttttttatgaaagaagaataaaaatcctgccacgaaaaaagaaagaaaaaaagcaccggataagactccgagtaattcccagaacccaatccagatgccaagggcaagcacaatcaatccgtcggccagaccgattgcaccgtttgaaatccagcataataataacagtgcagttccgggcagaacggaaagaaaaattgcgggaagggcgggaaaaccggaagtaagagaagtctgcattttggaaaaaatcggaattgaaatccactgatactgaatacagaaataaaagattccggttataagaaaaagtaaaattttccaaagggagacgcattggtctttgaaatcttccaatcccataaaagctaaaaaaaataagacagcgattttgctttgcatagatttaatgacctccatttcgttgtgagcatcgggaacatagatgtagattttgtagttcggatttcttgataagtcttacgtgacgggtcaatccgccacaagaagaactgctgtgataacggtttccgctttgcgtaatataaaaagtgttctggttagaagaggagcggacacagcgctcacagggatggtatttttctccataaacattgcgaagagaagaaagattggattttgaagtagttgtaacagaaagagaaagataagtacaatcggaaaaggtatgatagacaccttgataatcggtcacataaaccatttcttcggaatcagaagtatccatatccgtattgttggaatcatagccagtccatgcatgaacagaagatacgatggtaacaggaattggctgaagtggaatcagagcgacagggcttttgtataaaaaagaggcttttaaggtaatccgtccattttggtaagaggacatcaaaagagagatgccatttttatgtcccaaaatctggggcagagcttcttctttcagtgcgttggaaagctgagtttttgcataagcgatgcatagggcactggaaactgcgccgacaggagaagattcagtgtcagattcgcagtaagcatacattccgagttcccggctgctttggctaagagatgcttgaatgactgactgaatccgatataaatcaagaaataaaacaaggattacaatagccaggaagaagaatggaaagacaaatgcactttctacagtcaggcttgcagagggctgaagagagtatttttcctttcgtgttgattttaaatagtttgattttaaattaagcctgtcagtgctatttacagagtagtttatcttatccataaatcctcctggaatgtatatatcctcgaagtcttttgggatttgaccgaatcaaaaaagtttctggcttttaaccaattgacttgcgaatatccacttgacttttgtgagaatacatgagtgcaaaaagggttatcggttacatatcatacccgtaagtgcgtacagcactccaggttttctgttgcggacctgtaaaaattgtttctgtctccaggctttcaatgcaggaatccatgtaaaatgaagaacgttttggaagtgttcgaatattctgttcaatcatatccatgcatcgaaatgcctgtgtctgttcagaagaagaatacaaaagaagatgcagataattttgataattaagcccggaatgggagcgaatggtatcgctttggagaagagtgaaaatttgtccaatctgtgagagatttagctgccagctttcagtcgatttaattgccggaacactgcctccaagcatgagctgtcttacatcaagcaggctttcggcataagcccatccggcaataataagtgcttctgcgattgccatgccctctggaattaaaagaagggaacataaggcagcggcggtcatagctgcttcttctcgtttttgagggtcagtataaagatacacacaattggccgcttcacgaattgcaatcagccggtggacggttgcttttaggttttcttcatcggaagcacgaccaccgattatgtattcagcttcataacttagggcatgtccgtctttttcggtgatataatttccaagtttgtccataacataagcctgcattaataatttaccggaatcgctgttctgactttgaagagtgcccatgcctttttgaagtgtgcggtgagaaagtgtatctgtaagagaaatttctttttgggaaacctgccggtctgagggcagtaccagaccaaggatgccaagttcacgcaatcgttttaagatggcgataggattattggtttccgtaaatgcgggagggtgttcttctgcttctgtgacatcaaattccatgtctggtagtccttgttctttttgttcttcctgatttttaagggtagagtccgtctgttcaaggaaatctcttaaagaagagatggcttgtgttccaagttgatttttaacagcccgggagacctgccccataaaagaacgtgcattttcatccgtagaaagcacatacccggtgattgcacaactttgaatctggcatctggtaagacttgtttcgagtgtgggcttcataaaagattccatttgccggacgataaaggaaggattaacttgactgcctccgtagccggcatcaagatagaataaatcataagaatctaataaatccttatcatattgggcgaaaatagaataaataccggtatcggctgcatgcattgcctgaatccgtcctgcctgagttcgggcaagctgaatacccgagaggagaagagagagcaggatagaaaaaatcaggcacatcgtaatcgtcatacttcctctgcatttcttcacagataaatcctcctgttaaatagaactgctttgttttgttattttgtctaagagtgattgaatcaaagaattgagctgatttttgaaaataatgacaagtccgattaaaacaaccaaaatcagtacaatttcaataacagttacgcctgattcatcttccagaaaaagttttagtaaattctgtttcataagtctcacctcctttctaaggaaaatgtgtgtttgactttaatggctaaataaatcaggtaaaatctaaaaatatagataaatcgattaggtaaaacttagaaatgcgggaagcattagaagtgccagaacgattacaagctgtaaaagcatgggaaagagaagttttgtctgtgcttcttctccgagaatccgtgcttttcgtttgcgattttcaagggcgtccgtgacctctttctctaagagcaggagagtattttgatttcctttttttaagttttgaattaaaagtacagataaaattttgtattccggacagggacagcggctgccaaaattttcataagcacgaggctgtgacagcccaccttttaattcatgacaggtctctaaaagtgcttcgtaagcaggacgtttgggcagattttgactccggtaatttttctgataatcgtctgcaattttttcaagacttgcacgtatcgtaagaccggcatgcaaaaacaacagcagtttactgacaagatcgggataatctctttgcatcagtactttttgcttttctattttttcttgttctttttgccgtttcaatggaagaagtaagaaaccgagcaagctaaagaagatacagacaaaaagaccagtctttgcgggttctttataaaagaatagatgctgcccgtcaattgaatcaggaagagcaagggttggattgcttgaagaatcatttgtaactgctttttgaatggaggcatttaatgatttttctttgcttaatttttcaggataaacataaagctctttctgccatgaaagcgtctcttcttcaagcgaaagctgacagcgaagcgtaacggaagcacccttagaagggacatcttctccgatagcaccggtatagtcgagtattttagggtcagaggttgtccaaaaaagctgaacaggacaatcaggaagagattcgggaagagaaagcggtgtatgaatggaagaaaaactcttattttttccaagaatggaagaatccagtttttttgaggcttcatctaaaagagtctgtgattcctctttgctgtaggttttggatggaactttcagtgtaatatggtgtgtttttccatcgtctgtctgaaatttcagggattcttcgtgaatgctttcattgtattcgctacgttttaaatcagtaacaatatcgggatgtcggctctgccataatccaagagaaattcccagaagatttccaaagagaatcagaaaaatactgactcgcagcagggtttgttcctttgcatcttttaggcttggtttcaagtttgctttaggttttaattttgctttagagtttaagtttgttttagagtttagttttgttttagatttcaatttgaaccatcctcctgccaaagaaaaatgctgtcaggtacaagattaggcagattgtcatgatacagactccggctatattgtgatagagaacatcaagaaagcctggagaggtaagacgcatataaagaataattccggcgggcataagactcataaaggtatgttccattttttttgcagaaagcagagagtcaatttcttttttgacgtcaattttttcttcgatgatgcgtgcacttttttccaaagtttcccgaagatttccacccgttcgttttgcctgtgcaataatctcagaaaagttacggatatcttctacctgactttttttaccaagttcataaaataatttttctaccggaacactgagaagcatctgagattccatgtaagataattcaagaaccatttcgctggaagttccgtaaatacgcattaaatctttttttgcttccgaaactgcattttcaagagaatagccggcagaaacagcggcatcaatagaatttaatgcatcccgaaactgatgataaagccgttttcgtttctcataaagaagctgttttttcttaaaaggaagatacagaaaacaaaagggcagaagaagaaaaaaagaaatcacgtttcggtagcataagtcattgacaaggaagcacaaaatcagagagaagaccgaatactgaatccgttctcgaagagaaaaggtataatggtcataagatagtttcacataagagggtttcataagaaattcctgccctttctaatttttcagtgtgtttcagatgatttttaaagacaagcccctgttcttcttcataacagaaaataggatttaactgtacttctccgttttttagtccatccagttcagagatttctaacactttacggcttttgtcacgcagacgtcccagatgaataaaaaggtcaaagcctgagacaatctgacggcggatggcagtaatcggcatattcaagtgaaccagcacaagggtttcaagtctgctgaccatatcggcacagctgtttgcatgaatggtagaaaggctgccttctgaaccaacattgactgcctgaagcagttcgcttgcttcgcttctgacttcaccgacaataatccggtcgggtctcattctaagtgccgtttttaataagtcagcagttgtgatttcctgtgaatcctcgatatttgccattcgacattcaagacggacaaggtttgggattccctggatttgaagctcagcattatcttcaatggtgataatgcgttcatcttttggaatataagcggaaagtgcatttaaaaaagtcgtttttccggctccggttccaccgccgattaaaatggtataacgtgcttttaccagagggagcaaaaaagataatacctgtttggtaatactttgcttttcgagcagagttttcattgtgatggcttctttaggaaattgtcgaatggttaaaatcggaccatccacagaaatcggcggaatgactgcattgacacgggcaccgttttccagtcttgcatccacaatcggatgcagggtattaatgacacggttacagcgggcaacaatctgttgaattacatcttcaagttttccacttgaagtaaaagtcttattccatgtaatcaagtgtccttcccgttcaataaaaattttgtcccatccgtttaccataatttcggtaatgctggtatcttcgagaagttcttgaagcacatcgagttttcggatggagcgaaataactcttttctaagattggctttttcattgaggctcagaccgtagtttgagccctcctgcaaaagcagttcgtcaattttttcgagaatttcttcatcatcggattcccataaagaatttaactgctcaaaaagctgattttgtaaggttaaaaaacaatccataactatgtctcctttgaaaacttaaaaaattaaaaaaagaaaagataagctataaaagataaaaagctgattgaaattaaaagagaaaattaaaggtatccggctttggaaagttcgtattttacggcatcaccaaatacaccggataaaaaagaatctggaaaatgagaactatcaggagggggaagaaaacaagaatgagttttttctaaaatgagttcctgttttgtgttcgttaaataggctttatactgttctgattttgccatagaaacaggttcttttaaattaggcagaaacaaggtattacattcagaaaaaacaggaaagacagcagaaagatttggaccaaaatcgagaaccagagtctgatagggattttcttccatagcaaaaagagcgaagagcgcttcacagtcggcggaagtaagattccagatatcctgcggaacatagacaggagggagataatgaagcgatccatttttttgaatcagtgaagcaagaaacgcaaaaggattttcttttttgtggcgcagcagataaaaaagatcgccgatggtgtaagcggtgttattagaaagaaaataagacagaccggaacaggattcaaagctgataaaaagagttggatttttttcggaaagaaactgggaagctgcaagtgcaaatgcagtttttccacagcgtgcaaccggagaatagataccgatgagcgtcaggttttgagtgtcagaatttgttgaatgttccattgttaagaaaatctgattggaacaaagtttcattaagtcctgaaaaagctgactgcatggttgatacttaaaaagacagggcagatttttcttataagagagattttcttcagaaagtagaatcaaagtttcagaaaatagagaaataagctgtggtgtcagcatggcttctgtggtaagaagcatggaaattgaatggtcagaatgaaacgtaagaagtttttcgagagaagtaaaggggagaaactctaaagaaagagtgcagttttgttgaaagccagaacagagacgacagataaaatcttcgttagaatcgtaaagtgcaatgatttttttggtcataaacaaaatcctccaattaagagcagggtggcaagaaaaatgggaactgtaaaatgaaaatgttcaggacgatttccggatttcatatagggatgaatttgttttttggaaaaaatatcggagacataagaaaagaaataagaaattcgttctaagaaataggcagagcttaaaaacagcaggcaggaaatcaatgcgccgatgaagaatgaaaaagcaatcaaggaaaaaatgtcggaaaaattgagaaaaatgccaagcgtaccaaaaagctttaaatctccagcccccattgcgtgaaaaataaacagtggaaataaaatcaggatgggaagaaaaaaatttttcagggagaaaagcagaccaaaaaagccgttttgaaatatctgataagagaaacccagaagaataccaagaaaaatccagagatttggaactttttgcaagaataaatcacagcagagagctccggcagataaaaaaagcagaaattgagcctgtaaaggcataaatataccagtcctttctgagaaaattggtaaaaataatggaaaaatcatgaaaataaggaataaaaatgacttcgacgaagtgaactaagaatttaagatgtgaatgattatatactttatttcgcccaatgtccagttaaaatgacataaaaaaagatttttgttaagacttcacaaaattactatttgcaataagtgtcattttcagttaaaatagatgttatacaattaggtggacaaaaagtccattgctgaaggagaatagccatgggtgtaattgtatttttaggtgacagtattacagatgcggggagaaccacctcttgtccgccgcttgggaatgggtatgtaaagggatttgcagactccgtcagtcagaattggaatgttttaaatcagggagttgatggttacattacggaacgaattgcagaagacctgcataaggactgtattgcgtttcatccgaattatgtaagtatccttgtaggaattaacgatgtaggactgatagcagaagccgacacaacagagcatgaaaaattgtatatgttggaagatagtattcgtgcttatcacgaaatgttatttgatttatcccgagagacgcaggcagaaatcatcacactggagccgtttattttcccaaaagatggaaaatatgaaaattgggtgccttggcagaaaaagatgtcaaagaatattagaaaactggcgcgtaattaccacgcaagatttatttcggttcaagaacctcttaatcgcgagattgaaagattgggacatgatgccatcaccacagattgtattcatttgaccgcaaaaggtcatgaaattctggcaaagattgtcagagatggatttggactttaaaacaagggagagagtatagttggttaaaatactctctcccttgttttaatacaattcccggaaaaatttctgaaccaaatcaaatcggcttgtcattccggcaagcatggcatctaagataaccagggcagccatacattctactacaacaaccgctcttggaacgataatcgggtcatgacgtcctttgattgagatatccagattttcgccggctcttgtgacactttcctgagtggcagaaatagatggagtcggtttaaatgctgctcggaataaaatttcacatccgtcgctgattccgcctgtgataccaccggaatggttggtctttttcgtaatgtggccagcttcatctgcacagtaagcatcattattatgaagtccgtcggattgtgcaactgcaattccatctccgatttcaaaagcttttacagctccgatagaaagaatggcttttccaaggttggcatttaatttctcaaaggcaggttcgccaattccggcaggcacgccgataatcatacattccaccattccaccggcagaattttgttcttgcatgcaggtttcaagatagtcggaagctttttttgcagcctctgcatcgggcatataaagcggattattttcagcttccgataaatcaaatttttctttattaatagcaacaggtccgatggacaaagtataggcggaaatctgaattccaagagattttaacattttcgccgcaactgcaccggcagcaacacgaccgatggtttcacgtccggaagaacgtccgcccccacggtaatcgcggaatccgtatttgatatcgtaattacggtctgcatgtcccgggcgataataattggcgatttcactataatcatgagaacgctggtcggtattttttaccataagggaaatcggagtaccggtagtctttccttcaaagacaccggaaagaatttccacgcggtctgcctcctttctcatggtggtaaaacgggactgtcctggtttcctgcggtcaagataagtttgaatatcctcttcacaaagcggaagtccggcagggcatccgtctatcacaacaccgatgccttttccatgagattctccccaggttgtaattttaaacaggtttccaaatgttgaaccaaacatagtttacacctctttttctttcgtcttacttgtcgatggattcccagcgtccggaagctccacatggaagcaccagcccgctttcggtaaccggaagaccgatttcctgtgaatctacttttccgttaaattgttttaattcggttgaaatcatataagttaaaacagcaggagcaagtccggttgtataggagttaatcaggaaaaacagaggattgtcacttaaaagtttagcacagagctttactaatgggtgaattgcctcttcaattttccagatttctccttttggtcctcgtccataagatggtggatccatgataatggcgtcgtagtgatttccacgtctgatttcacgttctacaaatttgacacagtcatcaaccagccagcggattggtgcatcgccgagtccggaagaaatggcattttcttttgcccaggtgaccatgccctttgaagcatccacatgggtaacatgagcaccggcagcagcagcggcaagagttgccccgcctgtgtaggcaaagagatttaatactttaatcggacgaccggcatttttgattttttcggaaaaccagtcccagtttgctgcctgctccggaaacagtccggtatgtttaaaactgaatggctttaagttaaaggttaaatttttatactgaatcgtccactgctttggcaggtcaaaaaattcccattctccgccgccttttttactgcggtgataatgcgcattcatttttttccatcctttgtgagtttttggagtatcccagataacctgagggtctggacgaaccagaagataatcgccccatcgttctaatttttctccatttgaagtatcaatgacttcataatctttccattggtctgcaatccacatagtgaaatcctttctatttattagttaactaaaaatataatatgagtgtcaaaaggtatcaattttcttcatattcgttaattagtatagcagaagcgcaaagtcgaggcaatgcgcaaatcaaacagaaatgagttattcttgaaaaaatatctgcatacattgagatagaatatatcattgttaagatacgaacctgcaaaagggaagaaactaccgacaggtcagtatgaaaaatcaggagggcttatgtacgaacaaatggaatgtggcgaagtgtgtaaaagatttcatacagatgagaaagctggactgacgcaacaggaagcagagaaaaggttaaaggcagatgggaaaaaccgattaaaaaaagtcagggaagagacaacgatagaccggattcaaaaacagttaaatgacccgatgatttttgtcctttttatggcagcgtctgtttctattctgcttagagaatttagtgatacggcaattattttattcgtgattggtttaaatacgatgataggtgtagtacaggagggaaaagcgaaaaaggcgatggatgccttaaagaaaatgacagcaccggaagccaccgtaaaaagaaatgggacttaccgaaaaattccggcagaagaacttgtaaaaggcgatgttgtaaaagtgaaagccggagaccaggttccggcagacattcgtttgtttttgtgtaagggaattgaagtaaatgagtcggcattgaccggagaatccacggcagtaaggaaagcctgcgagacgatgaagcaggaggttacagcctctgaacaaaaaaatatgctgtttctatctacggaaattgtgaagggaaatggagaaggaattgtagttgcaacggggatggagacagagcttggaaaaatagccaagatgataaatgaacaggaaaatgaaatgacaccgcttcaaaagagattgggagatctggggaaaatcttgagtaaggcggctgtttttttatgtctgttactttttttgatgggagtgcttcaacatagaaatctgttacagatgctgttgttatccatttctctggcagttgcagcaattccggaaggacttcctgcggttgtaacgattgtactggcacttggtgtggcaagaatggcaaaagccaatacgattatccgtaaattaccagctgtagaaacacttggagcggtcagtgtggtttgttctgataagaccggaacgttgacggaaaataaaatgaaagtgttgaaactttatgcggaggataaaaccttatcggtttctcaggttcgaccaagagaattttcccgtttgatgcagggatttttgctttgtaataatgcagtaatcggaaagacggaactgggggattccacagaacttgcacttctttctatgggagaacagatggggatatcgagagagcggttggaagaacgttatccgagattggaagaaattccgtttgattcagataaaaaatacatggttacgctgcataaagatcagagtcaagtatgcgcttatataaaaggtgcctgtgattatctgttggaagtttgtagtttctggtggataggaggaaagatagaaccgcttggacagattcagaaaatgaaaatcagacgagtaatggaagggatggcagaagagggacttcgggtgctggcactggcttttaaagaacatgtatcagactggaatgaaagcagtattatgaaaaatctggtatttgcaggacttgccggaatgatggatgcgccaagaaaacaagtaaaccagtcagtctatcaattaaaacgtgcaggagttcaagtcgtaatgattaccggtgactatcaggaaacggcattttcaatcgcaaaaatgaccggtattgcaagaaaaagagagcagtgtgtgaccggagaagaattagatgcaatgagtgatgcagaattttcttctaaaatgaatgacatccgtgtgtttgcaagggtaacaccggcacataaagtaaaaattgtaaaagaatttaagaaaaatggaaaaattgtggcaatgacaggagatggagtaaacgatgcaccgtcccttcatgcagcagatatcggaattgcgatgggcgcaaatggaacagatgtggctaaaaatgcggcagatttgattttggcagatgacaatttttccacgattgaaaaagcagtggaagaggggcgcagtatttatgtcaatattaaaaagtcgattttatttttattgtcctcaaactttggagaaattatgacgatgtttgtgtcgattgcattttcgatgccatcgccattaaaagcaagccatattttatgggtgaatctgattacagattcccttccggcactggcgcttggtgtagataaaaatgataccggattgttgatggcaaagaagccaagagatgagaaggaaagcctgtttgcgcatggaggatggctgcttacgattgggtatgggcttttgattggtgcgattactttgtatgcgtttctgacaggcggacagacttatgcatttacggtgcttggaatttcgcagttatttcatgcaatcggaatgagggattgtgagaaatctatttttcagatgaatcatctggaaaatccggttatgattttttctttttttacagggcttgcacttcaagtggcagtgacagagattccgtggctggtggaagcatttcagacccgtcgccttttgatgggagaatggctgtggctgttgggaatttcggcggttccgcttgcggtacatgaaatagtggtgctcataaaacgattaaaaaaagggtgacggtgtaaatatgcaagattttatataaaaaattgcatttaaaacacaaaaattcgtgtataagagataaaaaacgatgaaaatgcaagaaagacttgacaatcagtcataaagtagcatacaatactgcttagtaagccgaagaaaaatgaattggatggcaaattgaaaaaatcaggaggagagccatgacaccgtacagagaactcaacaaagaacagctgcaggtgctgaaagcccagttagaaaaagaatttgaagaagtaaaagcaaaaggtttaaacctcgatatgtccagaggaaaaccgtcaaagaaacagcttgaacttgctatggatatgcttgaagaattaaagagcacagataagctgaaatgtgaagcaggaattgactgtcgtaactatggtttgttagaaggtattccggaagcaagaagacttcttggagcaatgacagaggtaactcctgataaaattattatttttggaaactccagtctgaatgtgatgtttgataccatttcccgttctatgacacatggtgtctgtggaaatactccatggtgtaagttagacaaagtaaaattcttatgtcctgcaccaggatatgaccgtcactttaaaattacagaatactttggaatcgaaatgattactgttccgatgactccaaccggtccggatatggacatagtagaaaaactggtaagttcggatgatgcaatcaaaggaatctggtgtgtaccgaaatattctaacccacagggaattacttattcagaagagactgtaaaacgctttgcaagattaaaacctgcagcaccggacttccgtatcttctgggataacgcatactgcatccatcacttatacgaggagaaagatttcttattagagattttggaagaatgtgaaaaagctggaaatccggatcttgcatataaattcctttccacatcaaaggtaagtttcccaggctccggtattgcagctgtagctgcttctcctagaaacttggaagatatcaaaaaacacatgtcaattcagacaattggtcatgacaaaattaatcagttaagacatgtacgcttcttcaaagatatcgatggtatgcatgaacacatgaagaaacacgcagaaatcttaagaccgaaatttgaagcagtggaaaatacactggaaaaagaaatcggcggacttggaatcggtgaatggaccaatccaaaaggcggatatttcatttcctttgaatcaatggaaggatgtgcaaaggcaatcgttgcaaaagcagcggaagccggagtgaaaatgacagatgccggagcaacttatccttatggaaaagacccgcatgattctaatatccgtattgcaccaagtttcccgaccttagaagaattacagacagcaacagagatttttgtattaagcgtgaaattagtcagtgtagaaaaattactggcagaataagcataaaaaaagccatttgaacattaaaaataaagggcgggattccaaagaaaaggaatctcgcctatttttggataaaaatcacaatttggtcacagaatagggctttacttttgggataaagatgaattagaataaggaatgcataaaagaaaaataaaagaatcaaagaaaaaggggtaggaatatggaacagaatgaaagtggtaacaaaaaaaccgcaaaaccaaagaaaatcataattggtattctgattgcatgcgtggcggtgcttgcgatactctatgcggcaggagcattttatttttccagtcattttctcccgggttcaaagataaatggagtaaattgttctggaaagacacttgagagagtggaaaatcatctgacagatgaaatttcttcttatgcgcttactatcaaggaacgtggagataatacagaaacgatttctgcagataggataggactcagctatgtggatgatggaaaagtggaaaaacttttaaaaggacagaattcatggggttggattactgcatttacaaaaaaacatgaatatacaatgagtgcaaccaccacggttgatgaagaaaaattaacgtcagcaattgatggtttaacttgtcttgcagaagaaaacatgcagcagccggtcgatgcacatttggaaatcggtgataatggatacgaaattgttccggaaacagaaggaaccgctctggataaagacaaggtaacggaggttatcacaaaggcagtcaaagccggagagacagaagtagacctggaagcttctgactgttatttaaaaccatctgtttatcaggatgataaaaatctgattgcgcagagagaccagagcaatgcattcttaaaagtaaaaatcacaattgatttttcagaccgtcaggaagtagtagaccagagtttaattaaagactgggttacaacagatgaaaatggaaatgcagtcttagatgaagcaaaagtaaaagcgtatgtggtagaacttgcaaagaaatatgatacctttggttatccaagacagtttaagacctctaccggtgaaacaattaccgtaagcgggggagattatggctggctgatggcaagaaatgataccacaacaaaattaatcgaggcaattaaaagcggaaagtctcagaccattgaaccggaatatacatataagggatacgtacgtgacacaaatgatatcggaaatacttatgtggaagtcagcctttctgcacagcacatgtggttttataaaaatggtcaattacttgtcgatacagatgtcgtaaccggaaatcataatctggggcatgacaccaaaacaggtatttatgcaattatgtacaaagaaagaaatgcgaccttagtaggggaagattattcctcgccggttaaatactggatgccgttttatgcaaatgttggaatccacgatgcaagctggagaactacatttggtggaagcgagtatttaaataacggttctcatggctgtgtcaatacaccagaagccaatgcagaaaagatttttaataatattgaaaaaggtgtgccggtagtggtgtactaaaacttgagaagctgttgctttagcgatggaaaaatcgtggagtgacagcttctttttgtatatattagtgtatgtatcaggggtgataattcttttggaagtgttttttgtattgcagattgtgtttcaaatgcagtggaacattgacaaagaaagaaaaattgattaggataaagaaaacacaaaaatcaatgtgggcttttataaagttcatgattagaataaaagggagaaaacaaaatgaatatcgtagttttagcaggtggaaacagtacagaaagagatgtttctatttcatcaggagaaggcgtatgcagtgcacttcgtcagaaaaatcataaagctgttttagtagacgtatactttggaaaagaatcttttggggaagaactgtttcctgaagtctatgatgtaaaagcagaagcagacagcatgagagaaatgagtaaattagtggaagaaacaggaaagaccagaaaagaattttttggaccgaatgtactttctatctgtaaagcagcagatatcgtatttcttgccctgcatggagcaaatggagaggacggaaaagtacagtctgtctttgaattaatgggaattccttatactggaaccggcccgctcagcagtggaatggcaatggataaaggaattacaaaaatggtatttgaagcaaaaggtgttccgactccaaagggcgttactttagctaaaggaaagagtgaaacagcactttctgcttatgatatgaactatccggttatcgtaaaaccttgctgtggcggttccagtgtgggagtctgcattgcaaatgatgatgccgaatatgctgacgctttaaaagaagcattttcttatgaagatgaaatcgttgtcgaacagtttgtaaaaggacgtgaattctctgttgcagtagtagagggaaaagcctatccgattatcgagattgcaccgcttcagggcttctatgattataaaaataaatacaatgcaggttcaactatcgaaacttgtccggccaaaattacaccggaacagaccagtcagatgcagacttatgcagaacttggttacaaagtattaaatcttcaggcttatggcagactggattttatcatggatgaaactggcgcaatgtactgccttgaagcaaatacccttccgggaatgacaccaaccagtctgattccacaggaagcaaaagttcttggaattgattacccggaattatgtgaaaaattaattgaagtttctttaaagaaataccagtaggcggagaaaaattatgaaaaatcttacgttagaacatattgcacaggcttgtaatggcagttatcatggcagtgaagcacaggcaaaacaggaagtgcagagtatttttacagacagtagaaaagcggcaaaaggcggtttatttgtgccgattaaaggggcaagagtagatgcgcatgattttattgatcaggtcatggaagcaggagcacttgcaaccctaagtgaaaaagaccttggggagacaaactttccatacattaaagtagaatcctccttacaggcagtaaaagacattgcggaattttatttaaaacagttagagattccggttgtcggaattaccggaagcgttggaaaaacaagtacgaaagaaatgattgcagcagtacttggacagaaatataatgtgttaaagacacagggaaactttaacaatgaactgggacttccacttaccgtatttggacttcgtgcggaacatcagatagcagtccttgagatgggaatcagtgactttggagaaatgcacagactggcaaaaattgcacgtccggatacctgcgtgattacaaatattggtctttgtcatcttgaattcttaaaatcaagagatggaattttaaaagccaaaacagagatttttgatttcttaaaagaagacgggcatgtcatcttaaacggagacgatgacaaattagtgaccgttaccgatgtcaaaggaatcaagccggtattctttggtgtggaaaataaaaacggaatctgggccgatgaaattgagagcagaggcttaaaaggaattgaatgtcggattcatgtaaaagatgaaagttttaaagtgctcgttccgattccgggacgccacatggtttataatgcccttgcaggaacagcagttggtttaacttatggtttaaccttagacgaaatcaaggctggaattgagagcttacagtccttaagcggacgcttccatatcttggaaaatgagaagaaaaatattatggttattgatgactgctacaatgcaaatccggtttctatgaaagcttcccttgaagtgcttcaggatgcactcggacgaaaagttgccctgcttggagatatgggagaacttggaaaaaatgaagtggaaatgcatcgtgaagtcggaagatttgctgccgaaaaagacattgatgtgattgtgtgtacaggaacattatgtaaagaaatggcagaagcggcaaaagaagtttcaaacggaaaaaaagtattatactttgaaaacagagaagcattagaagatgcactggatgaattaattttgccaggtgacagtattttagtaaaagcatctcactttatgcagtttgagaaaattgtaaagaaattagcggaataataaagaagaagtttaagtttattgcttttgcgaatagaaaaatgatggtacatctgataaaatgaaactatagaaaagtacaacgatagtttcgatttgtatgctgattaggtaaggaggtatcatcatgaaaaaaacaatttatgtatgtatttctgctgttttgttaatgtgtttgattgcacttatcacttattatattccggacttaaaaatcaagatgcttgtatcttttcttgttgtgttgacaggaatttatacgattagaatgggtatcattcagaaaaaacgttaattgcatagtaatataaaatgggctgacatatcgagtagtttgatatgccagcccattcttttattcctcatgcgccacaatattttgcaaccagactccttttttcactaagataaatccgatgacacatttaatgatatcacccaactgtaccagcgtatagattccaataaccggaagtgccgtaaaacggcttaacgtaaatgcaatcgttacactcacacaccagataaatacactgtcaaacaagaaggtgataatcgtctttccgcctgaacgaagggtaaaatatgaagcatgcagaaatgcattttgtggcatgaaaattgcggtgatcatgataaagtattttgccagttcccttgcttctgcattggtgttataaagcaatgggaagaatggtgcgagtaccagcatcacaagtgccacgcaggtacagcaaaatacggaaaaggcaatcatcttggtatcggtttctcttgcctttttcatttctcctgctccaagcagctgtccgactacaattgcgacagaatctccaagtgcaataaatacaatattaaagacattgttaatggtattagaaatatttaaaccagctacgacatttaatccacgaaccgaataacattgcgtcagcattgccattcctgctgcccataatgcctcattaaataatagcggtgttccttttatcaagattttctttgtcatataagccggtacttttaaggtacgataaagtccttcgatataagggtttttctctttatggcggtgcgtccagctgataacgatgatggcttctacatatcgagaaagcacagttgcaatcgcagcacctcttactccaagaaccggagctccaaattttccataaattaaaatatagttaaataataaattaattaaaacggctgtaattcccgctttcatcggtacaaccgtctcgccacactcacgaagggtacttgcgtaaacctgtaccatcataaatggcggaagtccgacaagcataatccacaaatactgttttccatacagtaaagttgctgctgcattttcccttgcaccttctccatgcagatacagctcaatcagccggtccccaccaactaaaaaaataacaatggttgctaccgtaagaatcagtgccatccataatttatagcggaaggtatttctgacgccctcctggtctttttgtccaaaatactgggcggtaaaaatacctgctccggatacacctccaaagatgcagagattgtatacaaaaataagctgattgacaatcgctgcgcctgacatctgttctgttccgattcgtccaatcatgatattgtctaacagactgacaaagtttgtgattccattttgaatcataatcggaacagcaatcagcagaatcatcttatagaacttcttatccccgattaactttgaggcaagtccctgtttttttactgctttttctcccataacttctcctttctcctaattcccatccaacatacagtgcgaaagctgtaagggataggatactacacaaacacaattttttcaattgtttttttcgacaatcttttttgccgttttttggcttgctatccaaaagctttttgcttataatatctcttgaatattaataatataccatacggtatagaaaggcggtttttatgatacgttttatttgcgtatgtatcgtagtcatcggttatctgattttatccattccgattctgcttgtagaatgggtcattggaaaattcaacaaacgtgcaaaagacattagttctcttcgcattatccaggcagtctttcgttttatcctgaaaattaccggagcagatattacggtaaaaggacatgaaaatgttccggcagatacagcagtcctttatatcggaaatcacagaagtttctttgatattctgctgacttatgtactctgccccgatgtcaccggttatgttgcaaagaaagaaatggaatccattcctctgttatcaatatggatgcgttatcttcattgtctcttccttgaccgtaaaaatattaaagagggaatgaaaacaattcttttggcaatagaagaaatgaaaactgggatttctatctgcattttcccggaaggaacaagaaatcgaaatgaaagtgaactcgatctgcttccgttccatgaaggaagttttaagattgcaaccaaggctggatgtccaattgtaccgattgccattcacaattcagccggaatttttgaagcgcagtttccgaaaatgcgaccggcaaaagtaatagtagaatatggcgagccgatttatccggataaactggataaagaagagaaaaaacatattggtgcgtatacgcagaatgtgattttggaaatgttaaaagaaatgaatcaatgaaaataataagattatcaaaaaaaactctggctaaaaggtcagggttctttttttttgctctttggcatacattattggtaagtcagcgaaggaagggcaaaatgaggcaaaaaatccatacaggagtgttattgtggtcggttgttatcattttattagcgctatccggctgttcgattgaaaaagtaagcgcacaaaaacaggataaaatcgaatacactattttaaaagaggcggaatttccggaaaaagtgcaggagttgatagaggaaaataaaacaaaagagtttcagcttacttatcaggaacagggaaatttgtatctgataaaggggtatggagagcagaaaacaggcggttacagcatccggattgaggatgtttctctttgggagaatgccatacatgtacagactatgctgattggacccaaagaagaaaatttaaaagacgaaccgtcctatccgtatctggttattcggatggaagacagggatgaaccggttatttttgagtaaagtaaaagcagaaatgataaaaagagatagaaaagagggtataatgtggaactgattacaaaacgagtacatacaatgcggacgaaatgtgaagcagtaagtcaggttacgtttgatgaagatttgaatgtaccggatgtaaaaccggatgtgggacgtatgatacaaaagaaaggagaaatccagatagacgaaatgcaggtatcagacgggcatgtcttttttaacggagcactattggtggctcttttgtatgtcagtgacagtatggaacgaaagatccaaagtctgctcggtacactgccgattgcagaaaccatgcatttagaagatctgcaaagtgggcagaaagtaaaacttgaatgggaacttgaggacttgagtgtccagctgattcattccagaaaattaaatattaaggcattgattacatttactgcaagggtggaagaacttgaagaaattcttctgccggcaggagtggaaacccctgagatttcccagaaaaaagaagaaattccggtaatgggaatctgtatacataaaaaagacaccatgcgggtaaaagaagaaatttcccttgcttcgaataagcctaatattcatgaacttttatgggatactgttgaaataagaggtgtggacattcgtgcaaaaagtgatagaattgcagtaaagggagaactatttttatttgtactttaccggggagaagatgataactactctcttcaatggctcgaacattccattccgttttcggaagaaattgagtgtgcaggctgtgcagaaagcatggtgccggatgttgatgttttgcttgcgcatagtgaattgaaaatccgaacagacagtgatggagaagagcgagtgcttgcagttgaagcgatgctggaacttgaaatccgaatttatgaggaagaagaggtttctcttttactggatgtgtatactccggcaaaggaacttcgggtggtctgtaagccggcaaaattagaatgccttttagtaaaaaatttttcaaaatgcagagtaggagaacgtcttaagacaagtgaaaatcaggggaaaattctgcaaatctgtcacagtgacggaatggtaaaggtggacaatactcatattatggagaatggaatagaaatagagggtattgttacggtcaagattttatatattatcagtgatgacgaaatgccgttttattcgatggatgcaatgattccattttcacatattgtggaggcacagggaataggaaaagaatgtatttatcatctgcatacggatttggaacagctttctacaacgatgattgacagtgacgaaatagaagtaaagattgtattgaatctaaatgcgttggtgatgaaacaaagggaacggccgttgatttatgaaattgaagaacaggaactggacagagaaaaactgcaaagtatgcctgggattgtgggatatcaggtacagcctcaggatacgatgtgggatattgcaaagaagttttatacgacaacagaagagattatccgtctgaatcatctggagtcagaagaacttcatccatttgatacgttgatacttgtaaaatcagttgagagtaaataagaaattttcctattgaaaacgaccaaaagatgggctagaatgaatgtagaatgtttaaaaaagaatacaatgtacaaagaaatatacaggagaagaaaatgagattaagagcgttggcaaaaattaatctgggattggatgtaatcgggaaacgtgaagatggataccatgaagttcgtatgattatgcagacaatcaacatgtatgaccaactggagattgaaaaaaaagacgaaccaggaatttccattacaacgaatcttccatttattccgacagatgaaagaaatttagtttataaagcagcaaaactcttgatggatgaatttgatattcaggagggaatcacagtcgagctgcagaaatttattccggtggcagcaggaatggcaggaggcagttcagatgctgcagcgaccatgattggcatgaatcgtctgtttaatctggggcttactgtaaaagagatgatgaaacgtgctgtggcaattggagcggatgtaccatattgcctgcttcgcggaaccgcacttgcagagggaatcggagagcagttaagacctcttccgccatgtccgaactgctacgtactgattggaaaaccggcgatcagtgtttcaactaagatggtttatgaaaaattagattctgcccaaattgagcatcatccggatatcgatcggatactggaggggcttcagtggcataatttaaataaaatatctgaatatatgggaaatgtgcttgaaaaagttacgattgcacagtatccgataattgaggaaatcaaaaatcatatgaaagaacacggagccgtaaatgcaatgatgagcggaagcggaccgacggtatttggtttatttgatgataaagacacagcagagcatgcatgcgaggcgcttagagaaagcaaaattgcaaagactgtatttttgacaacagtatttaacaacggaggacactgataagatggatttagaaatgcatatggatgaatacctgcctcttagggatgtggtttttaatacattaagaaaagcgattttaaaaggggatttaaaaccgggagaacgactgatggaaattgcacttgcagaaaagttgggggtaagtcgtactccgattcgagaggcaattcgaaaactggagcttgaaggtttggttgtgatggcaccgagaaaaggcgcaaaagttgcttctattacagaacgtgatttaaatgatgtacttgaagtaagaaaaggaatggaagaacttgcaattcgccttgcgtgtgagcggattacaccggaacaattagatgaacttgacaaagtagaaaagaagtttttaaatctgattgacagcgaaaacttaacggaactggctgaagtagacgtagaatttcatgatattatttatgcgacaaccaataataaacgtctgattcaacttttgaataatttaagagagcaaatgtaccgttatcgaattgagtatttaaaagacagtgcggtaagaaggcagcttgcaaaagagcataaatctatttgtgaggcacttcgtacgcatgacaaagaaagcgcactgcgttatgtttatgtgcatattgataatcagcaaaaggcgattatcagaagcctgaatgaagaaaaagaagaataaaaactaaaaaaatggaaatgttaaaagagatgccaaaagaagggcatctctttttattgtgcaaaaaatatattctataaaatatcgggggaatatgatttatgagccattctatcagtatttcaccaaagataaaagaaaatgaatcctgttttcgagaagtattcaaagactgtgcggatattttgttccatacaatggaacttggtcggggaaaaacagtcgactgttttgtgatttatcttgaagtagcggtcagcaatatgattctcgaaaaatccgtacttggaaaattcatcaatgaactgtgcaaggtatctggagatgagattttagagcgggttgaaaaaaatgcattgggaatttcagatgcagtacagctggatacggtagaagatgtggtcgcaggagtatttgccggagatgccgtattttttatagatggatatgcgcatgctgttaagatttcagaaaaaggatatccttcgatgggagtatccgaggcagacagagagaaagtactgcggggttcaaaagagggatttaccgattccgttaaaaccaattcggcactcatcagaaaacgaatccgaaatccgggaatgaaagtcaaagagcagacaattggaagacgcagtcagacaaaaattcagattctttatatcgaaggactggcaaggagtgagattttagaagaactcgagacgaaactttctgattttgaaattgacggtgtgcttgacagtggagtgattgagcaactgacaaaagaaaactggctgtcgccgtttcctcagtttcagacaacggaacgaccggataaatgtgcgatggagctgttaaatggaagggttgtcctgcttgtggataattctccggttggtcttttaattccggcggtgtttaatgattttttgcaggtgagtgaagatgaatatcagacctttgaacttgcaacatttttaagagtgctacggtatctggcagttggttgtgcaatgttgttttcgggactttatctggcggttacggattttcatacacaggtattgccgacgaatctgattttatcttttgcaaaggccagaaggggtgtgccgtttccgggtctgatagagacattatttatggagattgcatttgaaagtgtcagagaagcgggggtgcgtgcgccgggaccgcttggaggtacaataggaatcgtaggagggctgatcatcgggcaggcagcagtttccgcaaatctggtcagtccggtggtggtagtggttgtggcggttacagcactttctgcccttgcaattccaaatgaggaattttctgcaccgtttcgactgttaaaatttggctttatttttcttggcggaacacttggaatgtttggaattcttttgggactctatatgcttttaagccatattgccgagctgaaaagctttggagtgccttatcttgcaccttatgccggaacgcaaagagcgggatacaggggaaaagaaaatggaatctggatgcttccggcaagatttcggacaagacgcccgctgtatgcaaaagaaagtcagaaaattaagcttagaatgaaaacatcggatgaagaggaaagaaaaaatgaaatatacagaaaatgaaacaatatcgcaaaaacagcttttttctcaggcaagtgtttccatgctgggcttaagcctgatggcagttccggaatttatgagattttcgttgaagacgatgatatttggactggttttaacaggattatttttctgggtgcaaagtatttattttgttcgtatctgcccatgctatgccagactttgcacttcgtttggaaattgggtgggaaaactgtttggatttatctatgtatcttacctgtggttcagtcaggtcgtgctgttatgtttgatagcagaccttgccaattattattttatagaacgcatcgacaaaagttggctgattcttttaacaggtatcgtttgtgcaataggaatgtatcaaaatgttgagaaaagaggcagaatcggagaaatcattctgccggtaattttattttttattctttttatgttatttcttgctttccgggatttctcatttgaggaaattatcagggagagccggagaaaaatgacgctaagagagctggcagaggcattttataaaattgtatgtctgtttttgccagtatatttttttccgtttatcttaaatcagacgaagcgaaatacatcggcaaagaaaagcatgaatggaagtgtctgtctgaatcttggaattttacttttggctctgttcctgcttttaggactgcttggaagagaagggtatatgcataaaaaatatccgatgattgatttaatgtcaggagtgaacctgtcaggagatttctttcaacgttcggatctcttttggagtggaagcctgttgttttgtctgttttatttatgtggaagtatcttcttttatcagcatgaacttttaaaacgctgtagattagaacgaggcacatggatagtatatgccagtgtggttttattttctgtgtttgcaggaaaacttgggttttcatttgaaacatatcgtacgctggtccagtatgggtatgggattatgtttccggtcttgatactcgcagcaggaatctggtataaacgaagaaagatgggaaggcgggagcagattcatgaagaaaatacagataaataaaatacgttgtatttttgcagcgtcactcgttgttgttacagcagtttttctaaatggctgtggaatcctgcttgaggatagaacttttgcactttctttatctgtggattacaaagagggtgaatatctggtctggtatggcatttcagatttatacgatgaggtgagtgagaaagaagagagcggtgaggtgaacgaaaaatcggaaaccgaattgaaaggcataagcatggaagaagcaagaaataaatttttgtcaagtcaggaaaatgagctggatatgggacatttaaaagcattgattttgggaaaaggaattttagaagatcaaattgcttatgagggacttttaaatcatcttgaagcacagccggcggtggcatccaatgtatccgtctttttctgcaatgaaatagaagctctaatgaaaacagaaagacagcaggaaattccgcttggggtgtatctgactaaaaagccgaagaaccagtcaaaaaaaacagtcttttcacctgtaaaacttcaggagctttacaggctttggtataatcagaaaaagcagccgagccttccggaaataaaaattttgcaggaaaaaattgttgtacagaataaaccagaaaaataaagtcgatactttgtctgtagagagaatcaaaacaagaaaagtaaaaacagaaaatgaaaaacaaaataaatcaaaaaggcaggcaaggtatgaaaaatgtgagaaaaaagagcgaaaacatcagatggaaattatggatattgtcagccggaattgcacttttgctgatggctggcggtgtccgaatacataagttaaaagaagaaaaatatgaacttcaaaatcggttagaaagagaagtacagcagaacattgcaaaggaagtgcttcggtttcatgtgactgcaaacagtgatacaaaagaggatcagaaattaaaaatgcaggtcaagacagagctgttagaatatatgaatggatttttaaaagaatccgatggattagaggagacaaaagaaatcgtgctgggacatcttacagagattaagcagactgcaaaagaaattgtggaagaaagtggttatgagtatcgagtggaagccaaaatggagaaatgtgagttccctgagaaagtttacggaaactgtacgtttccaaaaggagaatacgagacattgacagttacgattggagctggaaaggggcataactggtggtgtgtactttatccgagtctgtgctttatcaatgattcttatggtgtggtggcagatgaaaaaatagaagaattaaaaaaagttttaacagaagaagagtttatttccatctggaatgatccgaaagaacgaaaaaaagtacggatttcatggaaatggttttaagatgtagcttgcaatccgtaatcaataagggtaaaataagatgaaatacgcagtaaaagagaaaagcgaggcttttttatgaatcagaacagacaagcgccaattggtgtttttgactcaggtgtgggcggactgactgttgcaagggaaattatgcgaaatctgcccagcgaaagaattgtatactttggagatacggcaagggtgccttacggaagtaaatccaaggaaattgtattaaaattttcaagacagattgtaagatttttacagcttcaggatgtaaaggcaatcgtagtggcatgtaatacagcaagtgcactggcattagaagagataaaaaaagaaattgatattccgattatcggagtggtggaacccggagcgaaagttgcagcttcggtgacaaagaacaaaaaaataggtctaatcggaacaaaaggaacggttcattctaaattgtatccggaaattattcacagatatgataaggaaattcaggtgtttggacagccgtgtccgctttttgttccactggtagaagaaggatggctgaaagatgatgtaaccgtagaagtggcacgacgttatgtgactccgcttttggaacaggggattgataccttgattttgggctgcacccattatcctctgcttcgttccctgattcagaaactggtaggagattccgtaacattggtgaatccggcttatgaaacagcaaaagaactcgaacggctcttaaaaagtaaagggcttgaaaatcttcaggatgttcaggaagaatttccataccgcttttatgtcagcgatgccgcagaacagtttcaggactttgcaaattccattcttccgtatgatgtaaagatgacaaagcagattaatattgaggagtactaaaattatgaaaaaagatgtgctggtaacagtaagaggaatgcagtcgattgaatccgtggatggttcggaagaagtagaaatggttgcaaaagggaattactactttagaaatggacatcatttcatctgttatgaagagatgtcagaagggtttgataagccgaccaaaagtatgattaagattgcagataatgtagtggaagtggacaaaaaaggtgttatgaatactcatctggtgtttgaaccggaaaagaaaaatgtgactttttatgcgacaccgtttgggcagatggaaatgggaattgcagcaacaaagattgctgttcaggaagaagaagaaaatttaagtgtctcgattgattatgcgcttgaaattaatcgcatgcataccgcagactgtcagcttcatgttcacgtacagtcaaaagaagcaggagattttcgtctgtgctcataaaaaattttgtcagcaataaaaaagcattgagactttctgacgaaaaagtttcaatgctttttttaaattattttttactgttgtcttttgtcatctgatttgctttcgcacgcatctttttaaagaagccctgttttttaggcggagtttcaagagagcctctcacacctttgacacctgtgatgtagataccactgacatcagcttttacttctttttttaccggaattaaatcaaatacctgttcatcggcaacaagtgtcatgattcttggaccgacttttgcttttacgattggcagcttagaacgtctcataagttttggagtctggtcaattaccatctgaggcagaccggattctttaatcggaagacgcttcttatcaataatcagcatcggtattgtctgttttgctgcttcaatctgttcctgctgtgcttcttgtttcttctgggcttttttgccgagaaaatataaaacggcaagaccaattactataatcagtaatacaatcagtagaacaatccatggactcatttgtaattccctcctaagtatggctttctgacgtatttattattttagcattgtttttgggaaaaggcaataaaaaatatgcaagaaagggtttcttttaaagaaagttatggtataatgggaacgcttggagaatcgcttcaggccaatgcactgcagaaaaatgacgggggatgcagctgcttaacaacacagagaaaggatttataaatcgatgaagaaaaaagtattaattgctcttttggcattgacagttgcagtatctgcaatgggatgcggcagtaaaaaaagcgactccgaagattcaacaaaagccaaaacagaaagcagcagtgaagaggaaaaaacagcagaagaagtggagacagacagcgacggacatgttgtggctgttgataccgatgatatcacaaaatatgtcacacttggagactataaaaatttaagtgtaaaagtaccaaaaacagaagtgacagatgacagcataagcgagtatattaatgagcagcttacttataaaccggaagaaatcacagaagaccgtgcggtacaggaaaatgataccgtaaatattgattataccggatatatggatggaaaagaattttctggaggttcagcgacagatactgaccttttaatcggttccggacagtttattgatggatttgaaagcggactgattggagcaaaaaaaggggatgaagtaacgttaaacttaaaattcccggatccatatcagaataatccggatttttcgggaaaagatgtacaatttaaagtaaaaattaataaaatctctcagccggcagagctgacagacgaatgggtgtctaataacagtgatgtgaaaacggttgatgaatacaaagcagaagtgaaagctaccctcgaaacaagtgcagatatggaatataataataataaaaaatcaaatctgtttgaagcgcttgtcaataaaacagaaatcagcgaatatccggatgatttaatggaagcagcaaaagaaaaagtggaaaaacaatttgaaaattattatgcaaaaccatcaggaatgacactggatgaatattggaagtctcagtctattacagaagaccaggcttcgcaatatattgaggctcaagcacagaccaatctgaaacaaaatatgattgtacaggctgtgcttgacgcagagggaattacctttacaaaagatgaatacagagaacagctggataaatttgcaaaagaatacggatttaaagatgcagaggcattagagcaggcatacacagatgctgagcttgtaaaagacaatgttttatggagcaaagtatgtgacattcttgaaaagtatggaacaattacagatgtagctgaagacgagacaaccgatgagacaacaacagattccaatacagcagagtcatccgattctacagagacaacagcagacggggaaacacagacagcgaattaagtggtaactctttccctcttttgcatatactaaaatgagtataggcaaaagggggatttttgttgcaaagaaaaagcgtaagggatgatttttatgaacaggagcggtatgcaaatcaggagttacgtcgtttccgtgcaaattatccagagaatgcggcattaatccagaactatgtggaggatgcctgtgaccggatggattatgagggcagtagaatgtacgatgaatatccggacaggtatatgctgaagaaaaactgtgcgtcgatttcaaaccggataaaaaaggacagcgagacgatgggagtggaagcaggatttgcgaaaaagtgtcagaatcttccaaaggaaactttagatgacttagttgaagtcttgttctataatgaggtgtatcgcagacggttgaggcgtcgcagaggaaaaagattttatccgtaacagacagggaaaatatttttgggacttgcgattttagagtaaagcttttacaatagagacaaatgccgtaatggtattttgtacagcgagtattaaaaagatacttgatttacgctgtatcaggcagactgcaatggatgcagtaaacaagtgtttagttaggagaaaacatgacggaactagcgggatttttagaaacttatgtaaatacgcagatgatacggattataataagcggccccagaaaaaaggaggggccgtctaaaatacagattcgtccgctgtcattaaagggagaaatcaaatttcaggaaactcagacagttggacaaaaagaacttcataaaaattatgagcaaaatgaaattatacagcggatgttagaatggatggaacattcttttaagcagttgcagttagagggacaagatatcgatgcgacggtactgataagtaagaagggaaaggcaaccattaaaataaaaaaaagccggacccccaaagagtttgtgccaatgctcgcccataatcgaaagaagaaatatctgctggaagaaggtcggccggttccttttttaattgaccttggcgtgatgagtgaagatggaaagataaaaaacgcaaggtatgataaattccggcagctcaatcgtttccttgaatttattgaggatatcttaccgaagcttccaaaagaaagggaagtgacgattcttgactttggatgtggaaaatcctatctgacttttgcaatgtaccattatcttcatgaattaaaacattatgatgtgcatattatcggactggatttaaagacggatgttattgaaaaatgcaatcgtcttgcagataagtatggctatgaaaaattgaatttttatcagggcgatattgcatcttatgaaggatgtgaacaggttgatatggtggtcaccctgcatgcatgcgatacggcaacggattatgcgttagaaaaagcggtaaggtggaatgcatcggtgatcctttctgtgccatgttgtcagcatgagttgaaccggcagataaagaatgaaatgctcgctccgattttagaatatggaattttaaaagagcggttttctgcgattttgacagatggactgcgtgcccagatgcttgaaagtaaaggatatgacacacagattcttgagtttattgatatggaacataccccgaaaaatctgttaattcgggcagtgaaaaatgagaacaagaagtacagtgaacagcagaaagcagcatgggaagcctgcatagaggcatttcatgtaaaaccaacgcttcaaaaagagctgttcttagaagggaatcataaataaatgaaaaaaatactgacgaaagcagggattcttctgttggtctttatacttggagtgataggcttcagcagtctgatgaataaagagaccacagataataagatggatcttgaagaagccacgttgcctgtgatgagcatgaaaataggaggtgaaaaagcgaaccttatgtatggacatgctgggcagatgcaggtggattttatgagggaaagtctgacaccgttagagacagacaaggaactcacagtcagcattacaccaaacggtcataaaataaaagatttggtttatgaagtccgtacatcagatggaagcaaagtcattgaaaatgataagataaaaaatttcaaaaaagatggcgaggataaaaaggttacattttcacttcagaaatcaatcttaatgaatcaggagtactcgcttgcgtttacactgacaacagatgagggagactactactactataccagaattttacagcgttccggattgaatacagagaaatatctgcaatttgcaaagcagttttctgaagatacgtttgattcagatgcacgttcagagattgtctcttatctggaatcagatgattcaacaagaaataacagctttctggatgtcaatattcattcgagtgtcagtatggttatgtggggagatttgaatccgtcggttctttctgaaggaattccggtcataaaagatatcaatggaacgactggaagtgtaactcttacttattacattacggcagacgacgatgataagaatcaggagctttatcaggtagaagaattttatcggatgcgctatgatggaagtaagatgtatcttttgaactttaaccggagtacaaaacaaatctttacaggtgattcaagcagtattgcaaacggaagagtgaatcttggtgtgacttccaaaaatgttcagtatgtggcaaataagacaggagaaatttttgcgtttgtacagcagggagatatctggtcttataacactgcgaccaataaattagtgcaggtgtttagtttccgtaaacaggatgcaattcaaaattttgatgcaagagaaaatatttctcagcatgattttaaaatcattcgtgtggaagaaagcggagatattgactttgtggtatacggatatatgaaccgtggagaacgggaaggtcagacaggaactgcagtttatcactattacagcgaccagaatgtattggaagaaaaagtatttattccaagtctgagttcctatgagtttatgaaacaggatgtgcaggtgctttcttatgtttctacagacaatatgctgtatttgtatcagcaaaaaaaattgtatcgcattaatctttcagaaaaaacttatgaagtggtaaaagatggaatcgacacacaatgtttctttacgtccaattccaaccgtcatattgcatggttagaagagatgaagttatttgattcttctaatattattgagttggatttggaaaccggtgaacagaagaaaattacggcttcggatggaacgagaattcgtgcgtttggatttatcaatgaagatttggtttatggcgtagcagatgaatcggatattaagacggattctacgggaagtttttattatgcgatgaatgagcttcggattcaaaactttgatggcgaactggtaaagagttatgctgaggatggtgtttatattacagatgtgaaaatttcgcagggcttgattgagctgtcaagagcgcagtggcagaacgaccattatgctgaaattacaagtgaccacattatgaacaatgtaaagacaaaagaagaagaggttgcgtcaatagcaacggttacgacaactcgtcaggcgggaattaccagattggtgtactcggacgaaaataaaaataaaaatccgcttgtctcagttccaaagtggatggtattggaagacagcacgacgctggaacttgatgagggaacggatgataccaattattattatgtgtatgcaaatggcgggctgtacggaatttatacggatgttgcaagtgccgtgcaggaagcagatgcacagacaggtgttgtgttaaatcgtgcacagcagtatgtctgggagcgtggaaatacaaagactaaagtgacattaaatgtcgctgagattccagactggtttaagagtgcaaagaccgatgtttcttatctggaagaacagttgggagatggcggaacagtgatgaatctgacaggatgtaccctggaagaagtgttatatcaggtcagtgcacagcgtccggtgattgtaagccttggagatgcaggaaatcgtgtgattgtaggatatgatgcatacaatactctactttataatccggcagaccagacaacatcttatatgggaattaatgacagtactgcagcatttgaggcagcaggcaacgtatttatcagttacattgaaaagaagattgaataaaaaaatgagaaaaattggggcaaaatattttgctccaatttttttgcaacaaaatggcattaaaaagacactataacaatatagaaagaaaagtacgtttggaaaagtaactgtaaaattgtaaaatcaaggataaagcacagaaaaattccgaaagtacattaaagagggaggagggaaaaaatggaggaaagtcgggagctggtaagacaggcaaaaaagggaaagagagaggcatttgcaaagctttatgaaacagtatacgaggatatgtaccgatttgcactttacgtgttaaaagacagggaagatgcagaggatgctgtggcagagactgtggcagatgcgtttgaatccattggaaaattgagaaaagaagaagcatttcgggcatggatttttcagattttatccaataaatgtaaacgaaagctaaaagaatatataacaaaaacctattcttatgaggaaagtgaacaaaggttagaaaaagacagcaaaacagaggatatagcacacgctattcacgtaagagatgcattttattctctggaagaagaggaacgttacatggtggcacttcaggtgtttggaggttataaaagtcgggagattgcagcacttttacataaaaatcataatacagtgcgttcacaagtaagccgggcattaaagaagatgaaagaaaaactggattaggaggtgcagtgatggcgaaaaaagaagaatatcataatttaaaagacctgcagtcagatgagctgaacctggaaaaagtaatagaaaagattcgggaagaagcaaaagaagaagaaattccagaacgcttgaaaccggaacatttagatgaaattttaaattcacagaaaaagaaaggcaggtggcaggggatgaaaaaaagaaaatatatggtagcagctgcatgggtggcagttttagtcggaattggagtttccagcgtagcacttattcataaaaaggattcggcagaaattggtgcacagacagcttcttcggcaaaagacggaagcggaaacagtaccatttcgcaggaagcttcagcagaagaaaagcaggtggaaggttataaatctgcttccagctatgaagaaatttatcagaaattatttgtagagacaaagcaggcacaggaaacacaggaggcatggtattcgagttcatcgaatattgatgaagattatggaattatgaaggaaagtgctgtggccgatggtacaacctcttcaatggcaaaagcggtttcagaagataatagttcagacagttattcccggacaaatgtgcggacagagggtgtagatgaaggggatttggtaaaaacagatggtacttatatttatacgttaactcgttcaggcagactgatgattacaaaggcagaaggaagcaaattagaaaaggcaggagaaacttctcttgaaagtatgacagacaccatcagtgacatgtatgtggatgggaatacggtttgcgtcgtagcctacggatatgacaccgatgtctcgatggaaggagaagatacttatgcggtcaattcgacaaattatacgaaactttacacttatgatgtatcagataaatcaaacatcgtattaaaaggaacaatcaagcaggaaggatattatgagacatcaagaaaagtaggaaattacatgtatctgttttctacctattatgcccaggaagaaaatgcgtctaaagaccatccggaacttttagtgccgaagattaatggagtgccaatacaggcttcggatgtattttgtccggtagagcctcagacagatacgactcagcttgtaatttcttctgtcaacttagaggaaccggataaagtgatggcaagtcgttctttaattggagctggtggaatgtattatgtcagccagaataatatctatgtttgcatgagtcaatatcagacacaggagataacaacacagattgcacgcttttcttatgcagatggagcgttggaattaaaagcagccggacagattaacggaacaattcatgacagtttttgtttggatgaaaataatggctatctcagggcagttgtgactcgctatccgaatggatggggtggacaggaaagtaatggattatatgtcctggatgaaaatatgaaagtcagtggaaaaatcgaagatcttgcatttggagaaagtattcagtctgcacgatttttaggagacaccggatattttgtgacttataaacaggtagatccgctgttttctgtggatttaaaagaccctgaaaatccaaaagtgattggagagttaaaggtgaccggattttccgagtatctgcatttttatggggaaaataaactgcttggaatcggacaggaaacggatccggacactggagaattaagaggaattaaattatccatgtttgatatttccaatcctgccgacgtaaaagaagtcgataaaattgtattaaaagatattgatgtttacagcccacaagataattataagagtgtgatgattgatgcagatgaaaatatcatcggatttgcaatgggctcttatgataaagtgacttataatctgaaggggtattatggagtttttggttattcagcagaagatggttttacgcaggaactgatgcagagtttaagtaaggcaaccggaaattcatccgacagctacaatgtaattgatgaaacaagaggaatttatattggcgataccttttatctgtgccagaatcagggaatctatgcatttgaccggagtgacggatacaaagaaatcggcaaacttgagtggtaaaattcccttgcgaagcctattacaatgcgttatacttatgtggagcgggtttcctgctccacttttttcattacattttgagaagtaataaaaaactggatacacagggatggaaataaaggagaacaaatttatgaaactgacaacagtaaaagagatttacaaaaacagagagcagtatcttgataaagaagttactgtaggcggatgggtgcgaagcgtacgtgattccaagacatttggctttattgtgcttcatgacggtagtttttttgaaacccttcaggtcgtttatcatgattccatggacaatttccaggatatcagtaaattaaatgtaggagcagccattattgtaaaaggtaatttagtagcaactccacaggcaaaacagccgtttgaaattcaggcagaagaaattatggtagaaggagaatcagcaggagattacccactgcagaaaaaacgtcattctctggaatacttaagaaccatttctcatctgcgtccaagaacgaatacgttccaggcagtatttcgtgtacgctccctgattgcttatgcaattcatcagtttttccaggagagaggattcgtctatgtacacactccattaatcacaggaagtgactgtgagggtgcgggagaaatgttccgtgttacaacattggatatggaaaatcttccaaaaacagaagatggaaagattgattacagcaaggacttcttcaaaaaagaaacaaaccttactgtaagtggtcagttaaatggagagacttatgcgcaggcatttagaaatatctacacatttggaccgactttccgtgcagaaaactccaacacaacccgtcatgcggcagagttctggatgattgagccggaaatggcatttgctgatttggatgataacatggcacttgcggagtctatgttaaaatatgtaatcggatacgtgttggaacatgcaccagaagaaatgaatttctttaattcttttattgataaaggtttattagaccgtctgaatcacgttatgacttcagaatttgcacatgtgacttacacagaagcaattgaaattctggaaaaagtaaacgacaagtttgaatacaaagtattctggggatgtgacctgcagaccgaacatgaacgttatctgaccgaacaggtctacaaacgtccggtattcgttacagattatccgaaggaaatcaaagcattctacatgaaacagaatgaagatggaaagacagtagcagctatggactgccttgtacctggaatcggtgaaatcatcggaggaagccagagagaggattcttatgaaaaattaaaagcaagaatggatgaactcggcttaaatgaagaagattacggattctaccttgacctgcgtaaatacggttctacccgtcattctggatttggtcttggatttgaacgctgcgttatgtacttaaccggtatgcagaatatccgtgacgtcattccgttcccaagaacagtaaataactgtgatttataaaatggtttgaatatgccattttatgggagtttgacatcataaaatcagatgaataaaaaaatcccggagcactaatatcagagtgctctgggatttttttgattattttttatttgccagatttgcgttatgttttgcaaggaagcggttgatccgttcaactggatttaacaatttgctgatagaagaatcatgatttaaggtatcaatgagtaaagcaatatatttactcatatcacagtttacatagtattctttctgaagcagttcttctgtctgataaaccagatttgtggtaagcagacggtcaaatgcacctttttcataagcttcatcaaattttttgagaccattggtgaacagtccaaaagtagcgcacataaagatttttgcagctcctttttcttttaataaagcagcaacttcaagcatactgtcaccggaagaaatcatatcgtcgatgataatcatatttttgccttttacgtcagcaccaaggaattcatgtgctacgataggattacgtccgtcaacaatagtggaataatcacgtcgtttgtagaacatacccatatcaacaccgagtacgttggcgagataaatagcacgtccggtaccaccggcatccgggctgattaccatcagtttgtcattgttgatttcaatgtccggttctgcacggaacagaccttttacaaactgataagctggctgaactgtttcaaacccatgaagcggaatagaattctgaacacgagggtcatgagcgtcaaaagtaatgatgttgtcaactcccatgtttactaattcctgaagtgcaagtgcacagtcaagagattcacgtccggtacgtttatgctggcgactctcataaaggaacggcataataacattgacacggcgagcttttcctgcgatggctgcaatcacacgttttaaatcctgaaaatggtcatccggagacatgtgattggtctgtccgcaaagtgagtaagtcagactgtagttgcaaacatctaccatgagatagatatcatcaccacgaacagattcttttaaaattccttttgcttctcctgagccaaaacgtggggtttctgcctgaattaaataagagtcgcgttcatagccttcaaactccaggttgttaaagtgagaatattctctgtctttacgccagtctacaatgtagtcgttgacccttgcgccaagagcagaacagctctttaacggaatgattccgaggcgtcctacaggaagtgaatctaaaggtgtggtatcttttggtgatggtgacattttttactttcctcctaatagttttttttggattcttatgtcatttccaattagtttgagcatggtgtaattactggatattctggagaagatacgttctgagtaagtttccagaaaattttccatggtcaggtttgttgatataatagtggatttatgattgataatgcgctcatttacacagaaaaacagctgactggcaacgaaagaatttacaagttccgtgccaaggtcgtcgatgattaataaatcacagtttgctatatattctgccatatctgaggcagcagtatcctttttaaatgtgttttttgccaacaggtcaaataaatcaaaagatgaaaaatataagacaaaataagacctttggattaattctttggcaatacagtgggaaagataggtttttcctacaccggtatcaccgtaaaagaaaatgccggcaggatggctggcaaaattatcaataaaatcccagcatttaaagtaagcatcccttgcggtttcaagtgcatttaagccggtagcgggattttttacttcctcagaataatattgaaacgtaaagttttcaaaattttctacttctaagatttcgcggatatttgactgtgtataaagtaagtcaacagccgccttgcgaaaacaggaacatttctgattatcgacatatccggtatccttacagtgcggacagtcatagtgaagttccagataatcagcgggaaagccgtttctaagaagcagtgtcctgcgttctttggagagtgtttcaatttcatcagagagattgaaatctgctgatgaagaaggcataagaagagccctggctttttttaaactaagggatgcaatttcgttgtcaatctcctgaagcctgggaatccttttataagcaatccggatacggtctcgctgttcatgtttatgttttaattgtttctggttatattggcgcataagtgcgtcgtattgtgagttatttagtgacacagtttttcctctttttatttgttcaacagcagtttttcaagttcattaacattatacgcacgctgatgaaagttattgaatttattgcgggaggcagatgactgagcacggggagccggagcctcgttttttgcagcctttgcctgtttatgagaatcttccagcttttccacatcggcaacatcatgaacagctcttttctgccagcttcttaaaattgagtcggcataaggaaaatttggctgaccggttgccatgactgccttgctgcaggcaagggaaataatttcaagagaaaatccaagttcgtcaagccatacattcatgtagcggatttcttcatcaatcggatttcggtttttaatcccaaacgcgcgcaaaatcgcaaagtaatttttgttgtatgcagtggttgccgcctttgcctgttcaatagttgtgatattctggtcagcccaggaaagtgctacggtttctatgtagcggatgctgtggctgccttttgatacacaatactcaatcaggtattccataaggtcggttgaaaaatgaagttcgtcataaaaatacaataatttattaatttcgattggagagagtgcttttccaagatactgttctgcaacaaaaagtatctgaataacatcttctcgttcggttaaagccctgattttttccgccgataaagaagacggctttgcaagttcatttgaaacagcttccgaaccggttggaatttcagtagaagttgaggctgtagaaactatatttgcagcactggttggagcctgcggaagatttgcgcccacaggaagcagacggacactgtttaaattgccttgttcgtccaattttaaatcaagcactcctgatttatgccagtattttaatgccctgagcacatcattttccgtacaattaaaaatgtcggcaatcgatgacagctcaagtgaagcggaaacgccggtggcatttcgtaagagataaagataaaccttaacgaattccccgtttgcctgtggcatacagacatcgaggaaatagttggagattaaagtgtaatctccgggaaaatcattacagagtgtaaactgtcccatttccaacatccttttctaatcaatctatgtccaaactcagtataacatagaatttttgaaaagagaataagcattttttgacaaaaaactctgcagacatttccttaaattagatattaggaatgcctgcagagtatataagttcttacagcccgagcagatgttctccgattttataaacatcgccggcgcccattgtaattaataagtcctgcggtacacagttttccagaaggaaatcttcgatttcgtcaaaagtagagaaataatgagcatctgttccaagtaaggaaattttttcctgaaggtctttggaagaaattcccagtgtatctgtttctcgtgccgcatagatatctgcaagcacaactttatctgcaaggcttaatgcctgggcaaactcatccatcagtgcttttgttctggtataggtatgaggctggaatacacaccagattgttttatgtggatagttttttgcagtgcgcagtgttgcggcaatctctgtcggatgatgtgcatagtcatcaataacggtaacacctcccacttttcctttatactggaaacggcggtctgttcctccaaaatgcaggagacctttctggatagattccagggaaagaccaagttttcttcccagtgcaatggcagacaatgcatttgagacattgtgaatgccaggaacggaaagtgaaaaatgaccaagtaaagtacctttttccatacaatcgaaggaagcgtgtgcagtttcatcaaattcaatatttgcagcagtgtaatctgcatcctgttccagggcataggaaataatttcgcatggtaaatcctttgtgatttcggcaacatttggaatatcctgattgataattaaagttccgtctttcggaagtttttcggcaaacaatcggaaagaatgacgaatatcatcaatatctttaaagaaatccagatggtcggcatcgatatttaagataatgctgattttcgggaaaaagcttaaaaagctgttcgtgtattcacaggcttctgtaacaaaggtttcagattcgccaacacggatatttccatggattgcaggtaagattcctccaacggaaatagtagggtcagcgtctgcttctaagagaatatgggaaatcatggaagttgtagttgtctttccgtgtgttccggaaacagcaattggagtttcatagttgcgcataatctgaccaagcagttctgctcttgtgagcattggaatctgtttttcttttgcacaggcaaattccggattatccggatgaatcgcagctgtgtagataacgagttcaatatcgtctgtgatattagaagcacgctgtccgatatagacttttgctcccagactttccaagtgcgttacaaggtcagaaggtttggcgtccgaaccggaaattttaaaatcttcttttaaaagaatttcggcaagaccactcatgctgattccgccgataccgataaaatgaatgtgtaatggtttattaaaatctatttcatacataaggcaacaagttcctttctatctttaattccttaacttttacatctttcaatagttcattatacataaaaaaaatgggaatgaaaaccctttcttaatcaaaacgttagagacaagtaaaatgtcacaaaaacaatggaaaagtcgaaaaaaaattgttaaaaatgttcacaattttgatttgatgtggtataatagaagaatcataaatatatacaagaggtgattacatgattaagaaagagatgattgccatgttgcttgcaggtggacagggcagccgtttgggtgtactgactgcaaaggtagcaaaaccggcagtttcgtttggaggaaaatatagaattatagatttcccgcttagtaactgtattaattcaggagtagatacagtcggagtactgacacagtatcagccacttcgcttaaatacacatatcgggattggtattccgtgggatttggataaaaatgtaggtggtgtttccattcttccgccttatgagaaaaaaacggatacagaatggtatacaggaacagcaaacgcaatttaccagaatatggcatatatggaaacctacaatccggattatgtattaatccttggtggtgaccatatttataaaatggattacgaagtaatgctcgatttccataaagcaaataaagctgacgtaacattagcttgcatgccggttccgtgggaagaagcaagccgttttggtctggcaattacagacgagacaggacgcatcacagaatttgaagaaaaaccggaaaatccaaagagcaatcttgcatctatgggtatttacatattcagctggccagtattaaaagaagccttacttgcattaaaagaccagccaggctgtgattttggtaaacatattctgccatactgcagagaaaaaggtcagcgtctgtttgcttatgaatataatggctactggaaagatgtaggtacacttggctcttactgggaagcaaatatggaactgattgatatcattcctgaatttaatttatacgaagaattttggaaaatctatacaaaaacagatattattccgcctcagtacatttcagcagaagctgttgtagaaagaagtatcatcggcgaaggcagtgaaattcacggtgaagtttataactctgttatcggacctggtgtagtgattaaaaaaggcagtgtagtgcgtaactctatcattatgaaacagtcctttatcggagagaatgtaacaattgataaggcaatcatcgcagaaaatgttacagttggaaataacgtagtaatgggtgttggagaagacgttccaaataaagaaaaaccaagtgtatactcttttggtttagtaacaattggagaaaattctgttattccggcagacgtaaaaatcggaattaacacagcaattgttggagagacaacaccggaagattatccggatggagaacttgcaagtggagaaactttaaataaggaaggtgagacagcatgagagcaataggaattattcttgccggcggcaataacaataaaatgaaagaattatcaaacaaacgagcaatagcagcaatgcctgttgccggaagtttccgcagtatcgactttgcgcttagtaatatgtcgaactcccgtattcagaaagtagcagttttaacacagtataatgcacgttctttaaatgaacatttaagttcttcgaaatggtgggactttggtagaaagcaggggggcttatatacattcccgccaaccattactgcagataataacttctggtacagaggaaccgccgatgcaatggctcagaacttaaatttcttaaaaaacagccatgagccttatgttgtaatcgcttccggtgattgtgtttataaaatggatttcaataaagttctggaattccatattgcaaaacgagcagatgttaccgttgtatgtacggatgttccggctgatgaagcaaccagatttggctgtatcaaaatgaatgaagactgcagaattcaggaatttgaagaaaaaccgatggtaacacataccaacacggtttctaccggtatctatgttatcagaagacgtcagttaatcgagctgcttgaaaaatgccaggaagaagacagatatgatttcgtaaaagatattctgattcgttataaagaattaaagagaatctatggatataaaattaatacatactggagcaatatctccactgtagatgcttattatagaacaaatatggattttctgaagccggaagtcagagattacttctttaatcagtatccatccattcagtctaagattgatgatttaccaccggcaaaatacaatccaggttcacaggtgaaaaacagcctgatttccagtggatgtatcattaacggacaggtagaaaattctatcttatttaaaaaagtatttgtgggtaataactgtgtaatcaagaactctatcattttgaatgatgtttatttaggtgataacacacacattgaaaactgtattgtggaaagtcgtgataccattcgtgcaaattcttactattgcggagaagaaggcatcaagattgtaattgagaaaaacgaaagatatgtattgtaatgactaagcaggtttttacaaaataaaagatacaaaaatcggacttataaagagggctttttgagaaggctatgaaaggggaagggtttattatgaacatcacagatgtaagagtaagaagagttgcaaaagaaggtaaaatgaaggcagttgtatccatcacaattgatgaagaatttgtagtacatgacatcaaggtgattgagggtgaaaaaggattgtttatcgcaatgccgagcagaaaagcgactgatggcgaatatagagatatcgctcatccgattaactctgaaacacgtgaaaaaatccagggaattattcttcagaaatatgagcaggtacttgcagaagaaccggtggaagcagaacagcctgcagaataaaaagaataagagcgaaaatgaaattaaacggtatgtctgtagttgcaggcataccgtttttgctatataatgcttcaaagaataaatactgtaaaggaaataaaactatgattgaacaattgccaaaggcatttttagagcgtatgaaagccatgcttggagaagaatacgaagattttttaaaaagttatgaagctccccgccagtttggtctgcgaatcaatacgctgaaaatatctgtagaagaatttttaaaacagtctccatttcatctaactaaagttccgtggacagagaatggattttattatgaagaagctgaccgtcctgccagacacccttactatgcctccggactttattatcttcaagagccgagtgcaatggcgcctgctgctattttaccggttgctccgggggactatgtattggatttatgtgctgcaccgggcgggaaggcaacggaacttggcgcacgcttaaaagggcagggcatgctggttgcaaatgaaatcagtgcctcaagagcaaaagccctgcttagaaatattgagctttgtggaattaaaaattcatttatcacaaatgaagttcccaaaaatcttgcccgtgtgatgccggaattttttgataaagttttagtcgatgcaccatgttcaggtgagggaatgttccgaaaagatatggacgttgcaaaaacatgggatgagagtcgtccggaattttttgcaaatctgcaaagagaaatcgtttcaaatgcgatttccatgctaaaaccaggtggactcatgctgtattccacctgcacctttgcgccaatcgaaaatgaaggaacaatttcgtatatccttgaaaatttcccggagatggaacttttggaaattccggcttatgaaggattttcagagggaaatccagaatggggaaatggagacgacaccttaaaaagatgtgtgcgtattttcccgcataagatggcaggagaagggcattttattgcactgttgaagaaaaaaggaattctgtatccatccaagtccgatgtggcagtccagaaaccggaaaaagaagcatggaaattattaaatgaattctgggcgccaatggaacttccatttgaaaaagaacggattgaaatccgcaatcaaaatgtatattatctgccgccggcatcgaatcactataaaggaatccattttgtccgaaatggtttattcttaggagaattaaagaaaaaccgctttgagccatccgaaccactggcgcttgcgctctcacaagaccagtttcctgcaattctgaacctttcgagtgaagaggaacgggttgcacgttatttaagaggagagacacttttaatcgaagatggcgaagcaaaagtgaaaaagggctggcagttagtatgtgtggatggacatccgcttgggtttggaaaactggtgaatcagactttgaaaaataaatatccggcagggtggagaagaaattcgtaaagaaattgaaaaaggattggaaattgaatgcttatctgcgttcaatttccaatccttaaaaaataaaagaaaaacggtacgacatttctgccctaccgtttcttcgttgaagtcgaagcgacgtgattcgaacacgcgacctctgcgtcccgaacgcagcgctctaccaaactgagccacgcttcgttaaaatgtttttcgcattcaacatttgcaattatactggaattgaatcaaattgtcaataaaaaaatgaaaatttttaatttttttttcatatacttttgacatttgcatcatatacttttaaagaacaaattttttggagaattacatgtctggatatcgacgatttattgcttatgtatatgaatatgagggaagaaaaaaaggaaatggaaaaggatttataaaagttgaagttcgggatggagtctgccggatgcagtttcggctgtcaggtgtttatggacaggaaactcttccatgtgaaatttatggatatgtaagagaggaagaaaaacaggaatgtgaagcagtttatcttggaacttgtgatttggcaggagaaattattgccttttcactggaactaacaggagaaaatgtctcggaaagtggatattcaatcgatgatttcaatggaatcgtgtttttagccggtgatgtgatgtatggaaccggctgggatgaaaatccggtgtgtctcgatgaaattcggtttggaaagaaaaaagaagaaaatggagaagagatagaagaattaaaagaagaacctgaagaaacagaaggtgaagaggaaggcagagaagaaacagaactggaaatacaggaaaatccatttccaccgacaccaagtatcttagaagaagtcggagaggaatgtcaggaagaaataagtgaaacaggagaaatagaagaaaaattagaggaaccagaagagccggaggaatcaggagcgttagaagaaccggaagaatcaagtgaactcgaagaatccttctactgtccatttaaggacggcgaatttgaacagtgtgcaaaaattggtcttttggattataatcagctaaatccatgtgaccagggacttttaaataataatttcctgcgttatggatggagacggtataaacatgccttgattggaaaagatacgaagagaaattgttacatacttggagtgccgggaacgtataacagacaggaagcactgatggcgggaatgtttggattcccttattttaaagaagcaaaatgcgaaacaaccgaaatgtctgcacaggaagtacaaggacatttcggttattggtatcggtcaatcaatccccctgatggaaacagagggaatcgttcttaataaaatcttttgaaattgttctaattcggtttttgtataactggtgaatccgggatgaatcacatccggagaatcgcggtatgcctgtaagaaataggcctgacatccggcaatccacttaccgatagattcaaaatcggctttgtcatgaagttcacgtacaacggtagtacgaaattcgtaaggaatcacattagagagcagaaattcaacagattcacagatggatgttaaatcaatgtttttgcagccagatacttttgcataagattctttggaagatttaatatccattgcaaccatgtcaatcatctgattgttcactaatttttttagagtccatggatggctgccgttggtatcaagtttaactggataaccaagttctttgattttatcaatcaacagaaacaagtctttatccaaagtcggctcaccgcctgtgatgcagaccccctctaaaattccctgacgtttttttaaaacagaaaggacttcttctgtgaaaatcacaggctgtttatttggagagagtacgagagaactgttctggcaaaatggacagcggaaattgcacccgccaaggaagatggtggatgcaatttttccggggtaatctaaaagtgtggttttgttaaatccgttgattggcatggtggaaatcctttcttgctttagggatgataattcgggctaatttccgtgtccctcttttgaaaaacgttcattatattcactcagaggaatgaacgtgtcactctgttttgcctgatttgcatgataaaagagaaaacctgcaccaatcaggataagtaaaataattgcaaaaattatgtttctggtttttgtcatgggcattctcctctctaaaatttgaacgcagataagcattcccccgcttcaagtgcgtagagcactaagcggcgagtgagcactttacatcacgttttttatatctaataaaattatactattttattagaatgtggtcaataaaatagattttttgcttgaccaaaagcaggaagcaccgtataatagaaaaacatggagatgtactcaagtggtcgtaagaggtcgcactcgaaatgcgataggtccttcgtgggcgcgtgggttcgactcccaccatctccggtgaatggcggtatgacgaaagttgtactgccttttttgttgcgaaaaaattcttgcgaataaaaaaagtgccggtacattttcatgtaccggcaaagagagggagggaaaagaaaaatctatataaaaagttaacttgcttattgggtgaaggccggcagccacaaagttgatttcgttcaaaccttactttcgtaaaacccaaactgcgatgcagccgctgtcttcttcatttgataatgctagtatatcccaaaaatatgatagaattgtgtccgtatcataaaccttttctgaaatttttaaacagagtatgaaaaaaataaaaagcaaccggttgcaatgggttgcaatgaaaaagcactctgttgtataattctaaatcatacagaaataggatgcggagaatgagagacgaagaaaaatttatgaaagaggccattcggcaggcgaaaaaggcgtatgcgcttcgagaagtaccgattggttgtgtgattgtctatgaagggaagattattgcccgtggttacaatcggagaaatacagataaaaataccacttctcatgcggaaatcaatgcaattcgaaaagcaagtaaaaaattaggtgactggagactggagggttgtacattatatgtgacccttgagccatgccagatgtgtgccggagcaattgtgcaggcaagaattgataaagttgtgattggaagcatgaatccaaaagcgggctgtgcaggctcggtcttgaatcttttggaaatggatggatttaatcataaggtagaagtggaaagaggagttcttgaagaagaatgcagtaccatgctgagtggattttttaaagaactaagaatggaaaaggcaaaagcgaaagcaaaagcaaaggagctggaagaaaatgacaaaacaggaatttaaagaactggtagcaaaaggaaaagtggtattagatggagcaacaggctctaatttgatgaaagcaggaatgccaagaggtgtgtgttcagaagcatggatttatgaaaatccacaggcattaatagaattacagaaagcctatgcagaggcaggttctgatattatttatgcgccgacattttctgcaaacagaatcagtctggcaaatcatggattagaggataaagtagaagagttaaatcgaggactcgtaaagattacaaaggatgcagtgggagacaaatgtcttgtagcaggagatgtgacaacgacaggaaagcaggaaattgcttacgaagaactgttagaggcttataccgagcagattcgcattttaaatgatgcaggggtggatttactggttgcagaaaccatgcttggagttacagaagtaatggcagtattagatgcggcagcagcagtctgtgacctgccggttatgtgtactcttaccgtagaatccgatggaagtctgttctttggtggagatatctatgaagcagtagaaagtctggaacagatgggtgcagatgcagttggaatcaactgttcaaccggaccggaccagttagtatcggttgtggaaaacatcagaaaacgagtacagattccggtgattgtaaaaccaaatgcgggtatgccggcaattgatgaaaaaggcaatgcggtctactcgatgggcgcagaggcatttgcaaaaaatatgaaagtattgatggatgcaggcgcagatattgtaggtggatgctgtggaacgactccggaatttattaaagcattaaaaaaagaaatctagaaaagaaaaatgataatcaggtaaaaaggcacttccggaaagattcatttctggaagcgtttttttatgtaaaagaaaattccaatgagagtgaaagcacaaagtacaagttttcctgcctgattataagagtggaaatattgtgccgtcttttgccaggaagcaccggcaaatgctccaagtgtgacgagtacggtattccagatgagacttccgaaggtggtgagaataaaaaatttggaaaaatgcatgtgcgccatacctgcgggaattgaaatcaggcttcttacaattggaataaaccggcagaaaaagacggtataatttcctttgctgtcgaaccattccacggcatgagagacatcctcttttttaaagtgaagcagctttccaagtctgccctctacaattgcttcaagtttgaaaaccggaacaagacttccaatctgataaagcacaactgcgccaaggacactgccaagtgtagaaaaaagaataaccccaatcagattcatatttgtataagtagttagaaatccaccaaaggtcagaattacttctgaaggaatcggaggaaacagattttcaatcagaatcaagagggcaattcccagatacccataatgattcatgatagaaatcatccaatattgcaataaaaaaacctcccctgcaatcatctcttttattctatgatgatacaaagaaggttatgatattctttttttaccgtgcaccgcccatcgagactccttcacggacgttacctctacagttaactcagcccaggcaccctcacggcacacaggggattctgcttagtgctgcttcattcctgacctgacacggttcacagagtcctgttgcgtgagacccaaacgtcaacgccacttatagagggcagccccgcaaagcaagcccctccgtttggcaacacccctgctgtagcggattgcaggtacagggcaccgctaactccccggctgcacggtgataccagtatatcggttttttgcaggtttgtcaatgtaaaaaagaaaagcagagagaactttttggaaaattttaagaaagtgggaataaattagtaatgggaggataaaagtatgtgcgcaaaacttttgttattactattactcgggattttttttgcaggattttctaaagaagaagcagccaaagaagatgcagggattccgaaatttattgtgacggaacaggaatttccgaagtttaatgatttaaaagcaaaagagagtaaaagtcaggtgttttctatctggaatcagacagaagagacggagtgttattatttttggggacaggcaccaaacgatgtagagattgaactgaaaaagaaaggggatttattttataaggggaaaatgccggagaaaaaaatagaactgacaacgttaaatccaggggaaaatatggtatttgaggtaaccgttttaaaagaaaaaaatgaatcgggagaggtggaactgttttttcaaaattcgcattgtgataaaaaataaattagtatataataaaaaatgacaagatcaaaatatcaaaatgctattcgtgtatgtacgataaggtgtttgaaagtaagacttgtaaaaacacaagatgggatgtgatgaatctatgaagcgaattggtctgctgacaagcggcggtgactgtcaggcgttaaatgctacaatgcgtggcgtggtaaaaggtttattcaataatttagaggatttggaagtttatggatttgatgatggatataaagggcttatctacggaaattacagaatgctttctgcgaaggacttttcaggaattttaacacgaggcggaacgatacttggaacatcacgtcaaccgtttaaactcatgagagtaccagatgcaaatggactggataaagtagaagcaatgaaacagacttatcataaacttcgtctggactgtctggttattcttggaggaaacggtacacaaaaaaccgcaaatctgttaagagaagaaggactcaatattattcatcttccgaaaaccattgacaatgatatctggggaaccgatatgacatttggctttcaaagtgcagtcaatattgcaacagatgcaatcgactgtattcacacaacagcggcttctcatagtcgtgtatttattgtggaagtcatgggacataaagttggatggctgacccttcatgcaggtattgcaggtggagcagatattattctgattcctgagattccttatgatattcaaaaaatcgctgaggcagtaaaaaatcgaagtcgttccggaaagggatttactattcttgctgtggcagagggggcaatttcaaaagaagatgcagcactttcgaagaaagaattaaaaaagaaacaggaagaagaaaagaaagtttatccgtctgttgcgtataagctggaatcagaactgaaaaaggaactggatttggatattcgtatcacaattccaggtcatacacaaagaggaggaagtccgtgtccttatgaccgtgtgctttcaacacgtatgggttctgcagcagcaggattgattctgaaagaggaatatggctatatggtaggaattgtaaacggaaaaattaaaaaagttccgcttgcagactgtgccggaaaattaaaaatggtttctccggatgaccagttagttaaagctgcaaaacgaatcggaatcagttttggagagtaatcgaattaagcagtcaggcggactaaaaatatccgcttgacgagcatgcatcattcgcatggaaaagcaagaaaacaggagaagaattaaaatgagctatgttgcgctgtatcgcaagtttcgaccgcaaaattttgaagacgtaaagggacaggagcacatcgtaactacattaaaaaatcagataaaggcggatcgtatcggtcacgcttatctgttttgtggaaccagaggtaccggtaaaaccacgattgcgaaaattttagcaaaggcagtaaactgtgagcatccggtagacggaagtccctgtaatgaatgtgaaacctgcaaagcgatttcggccggtacttctatgaatgtaattgaaattgatgccgcatcgaataacggtgtcgataatattcgtgagattcgcgaagaagtggcatatcgtccggccgagggtcgttataaagtatacatcattgatgaggttcatatgttgtcaaccggagcatttaatgctcttttaaagacgctggaagaacctccttcttatgttatctttattctggcaacaaccgaagcacataaaattccaatcaccattttatcaagatgccagcgttatgatttcaggagaattacggttgatacgatttctgaaagactgagtgaattgatggaaaaagaaggtacggaagttgaagaaaaagcaatccgctatattgcaaaagcagcagatggctcgatgcgagatgctttatctttattggatcagtgtattgcattttatctgggcgaaaagctgacgtatgaaaaagcactcgatgtgctgggtgcagtagatatggaagtattcagtgaactgttaagaaaggtgttagcacaggataccgcaggctcaattaaaacactggaagagttgatagtgcagggaagagaactgggacagtttgtaaatgattttgtgtggtatatgcgaaatctgttgttggtaaaaacttcggatgtaccggaagatgctgtggatgtctcggcagaaaatctggaacgtttaaaagaagagagtgaaatgcttgacacggagacgctgatgcgttatattcgtgttttctcggaactttccaatcagattcggtatgcgtcccaaaagcgcgtattggttgagattgcactgattaaattatgccagccggtgatggagacaaatttggattctttatttgaccggattcgcgtactcgaagaaaagatggaaaaagggattccggttttgacggagtctcaaaaagcgagtactcgggcactgccgcagccggaactgtttggcgaagaagctcaagaccaggaagcagtaaaaccacaaaaagcagcgccggaggatttgcagtatattcagaaaaactggactgcaattgtaagagaaacaagtggtctgttaaaacagatgttaaaagaagctacaccaaagtataatgcaaacagtgatgagccaattctttatattgaatttcacaattttcaggcggaaatctgtaccaaaaatccagataccattccgcttctgaaaaaaattattcgagaaaaaacaggaaaagaagtagaaattcagtttgtgattacgaatacggatttaaaaggtccggcaggacttacaccgatttcggtagatgaactgattgaacaaagcatccagatggatgtcgtagtagaagatatgagtgatgacgaggaggacatataatggcaaaaagaggtggatttccgggaatgggtatgcctggaaacatgaataatttaatgaaacaggcacagaaaatgcagcgtcaggcagaagaaaaccagaaagctctggaagaaaaagaatttacggcaaaagccggtggtggtgcagtagaagtaacaatttccggaaaaaaagaagtgacaaaagtaaaacttgcagaagaagtagtagatccggatgatattgagatgttggaagatttgattgtagcagcaaccaatgaagcgttaagaaaagtagagcaggaatctgctgcaatgatgtccaaactgacaggtggtcttggcggacttggtggcggactgttctaagttttagatactctggtaacttagttgccgagtagttcacgaaaatcaaaagacagaggaatcaaattggaatattacagcagtcatattaacaaactgatagaagaattttccagacttcctggaatcggagcaaaatctgcccagcgtctggcatttcatattttgaatctgccgaaagaacaggtggaagaactctcttcagcaattgtagatgcaaaagccaatgtctgttattgtaaggaatgttatactttaactgaccaggaaatctgtccgatttgcaggaatgaaaaacgcaatcatcatatcattatggtggttgaaaatacaagagatttggcagcttatgaaaagaccggaaaatttgacggggtatatcatgtgcttcatggtgctatttctcctatgcttggaatcggaccggatgacattaagttaaaagagttgcttcagcgtctcacaagagaagaaattgaagaggttattattgccacaaattcaagtgtagagggagagacaacggcaatgtatctgagtaagctgattaagccgaccggaattaaagtcagccggattgcaagcggtgtgccggtaggcggagacttggaatacattgacgaagtaactcttttgcgggcacttgagggcagagtggaattgtaggggtgtaattttatgaggaaaaaagttacatcaacagatatcgcaaaaaaagccggtgtctctcaggcaacggtttcgatggtattaaatcataaatataatgtttctttttcaaaagaaacagtggaaaaaattgagcggattgctaaggaaatgggatatacaatcccaaaacggcgccaaagaaaggagagccggaaagggaagctgattattgtattttgtccaacccttaccaatccgtattatgtcatgctgcttcagggaattgaggcagtggcgaaagaagagggatacagtgtttttacctgtaatacacaaagagaattgaaactcgaagaacaatatctcaagctgatgtcgagtgtagaccctgcaggaattatatatacctgtaatccaagttctgtatttatggaacaggtaggcgagattgcaaagaaaatcccgcttgtaattatcagtaacagggagaaagtacaggttgatgcaattaatcaggataatacaaaggtaggacgtttgatggcaagacatcttttggattatggccacagagatgttgcatttattacacctccgcttacccaacgtcagaagcagcgttccaaacgagtacagggatttgtacaggagtatgagcaggcaggacttggagaccgagttgtgataaaagcggccgatgcgtctttggatgaacagttgccgagtccggattcggaatataagatgggatataatctgacaaaagaacttcttgcagaatatgataatctgacagcgattgcgggattaaatgacatgatggcatttggaatcatggatgcactgcaggaagaaaaatataaaattccgggagatatgtctgtaattggatgtgataatatcatcttttcgggcatgtctcatttgtcgcttactacaattgaacatttcgttccattaaaaggcagggatgcatgtgatattattatccgaaagattaaatcatcaaaagatacttatgatggaacgaatccaatcagtatttatcacatcgagtatgaacccaaattaattgccagaaaaaccacttcttatgcacgggaaaaacgcacgaaagaggcaggaaagaaaagaaatattaaataaaatcagaaaagatattagtaataaaaaaacaaaaaaaggctgtatatagcagaaaaattatgaaatacagccgaaaaattattaataaaatgcatatttataaatgaataaaatcactaataatttttttgtgacttgcccgtaaacgaattatgaggtaaactataaccaacaaataaaacgaacgtttcacgggaggaaatgagttatgaaattttttattgatactgcaaatgtagaggatattcgtaaagcaaatgatatgggaattatctgtggagttactacaaacccatccctgattgcaaaagaaggacgtgactttaatcaggttatcaaagaaatcgcttctatcgtagacggaccaatcagcggtgaagtaaaagctacaacaacagatgcagaaggaatgattaaagaaggtcgcgaaatcgcagcaattcatccaaacatgattgttaaaattcctatgacaacagaaggcttaaaagcagttaaagttctgacagcagaaggaatcaaaacaaacgtaacattaatcttctctgcaaaccaggcattactggcagcaagagcaggagcaacttatgtatctccattcctcggaagactggatgatatttctgtatgtggaacagatttaatccgtgacatcgttgagatatttgaagttgccggtattgatacagaaatcatcgcagcaagtgttcgtcatccaatgcatgtaacagaatgtgcacttgcaggtgctgatatcgcaacagttccatacaaagtattagagcagatgacccatcatccacttactgaccagggtattgaaaaattccaaaaagattatcttgcagtattcggaaaataaaggtaagatgtgagtggcaaaacaaaattgccactcacttatattatgagaaattttttcaggaggaaactatgaacaaattagagcttcagaaaacagccaatgaagtccgcaaaggtattgtgacagctgttcattccgcaaaagcgggacatccgggcggttctttatcagcagcagatttatttacttatttatattttgaggaaatgaatattgacccgaaagagccaaagaaagcagaccgtgaccgttttgtattatccaaaggacatacggcaccgggactttatgctactcttgcaaacagaggatatttcccggtagaggatttaaaaactctgcgtcatatcggttcttaccttcagggacatccggatatgaaacacattccaggtgttgatatgtccagtggttctttaggacagggaatctcagcagcagttggaatggctttagccggaaaaatggacaatgcggattaccgtgtttatacattgcttggtgatggtgaaatccaggaagggcaggtttgggaggcttctatgtttgccggacacagaaaactggataacttagttgtaatcgtagataacaatggacttcagattgacggtaaaattgaagatgtttgttctccatatccaattgataagaaatttgaagcattcaattttcatgtaatcaatgtagaagatggaaatgattttgaccagcttgcagctgcatttaaagaagcaaaagaaacaaaaggcatgccgacagctattatcatgaagactgtaaaaggaaaaggcgtttcctatatggaaaacaatgcaggatggcatggaaaagctccaaacgatgaagaatatgcaatcgcaatggcagacttggaaaaggtaggtgaagcattatgtcagaagtaaagaaaattgcaaccagagaaagttatggtaacgcattagttgaattaggaaaaaaatacgaaaatttagtagttcttgatgctgacctggcaggtgctacaaagaccggaatattccaaaaagcatatccggaacgtcacattgactgtggtatcgcagaatccaatatgatgggaatcgcagcaggtctgtctacaacaggaaaagttccatttgcaagtacatttgcaatgtttgcagcaggacgtgcttacgagcaggtgcgtaactccatcggttatccacatttaaatgtaaaaattggtgcaactcatgccggaatctctgttggagaagatggtgcaactcatcagtgtaacgaagatatggcgcttatgagaaccattccgggcatggtaatcttaaatccatctgatgatgtagaggcaaaagcagctgtagaagcagcttaccttcatgaaggtcctgtttatttacgttttggacgtctggcagtgccggttatcaatgacagaccggattataagtttgaaatcggaaaaggtatcgtgcttagagaaggaaaagatgttacaatctttgcaacaggtctttgcgtaagtgaaactttagcagcagcagaaaaactggctgaggatggaattgatgcaaaagtaatcaatattcatactatcaaaccattagatgaagaactggttgtaaaagctgcaaaagaaacaggcaaagtcgttacagtagaagaacattctgtaatcggtggtcttggcggtgcagtagcggaagtgttaagcgaaaaagctccgacacagatgcttcgtatcggtatcaatgatgtatttggtgagtccggcccggcagtaaaattactggaaaaatatggaattgatgcagcaggaatttacaataaagtaaaagcattcgttaaataattatatttacaaataaaaagctctgttatagaatagggctaagtcttagaggtgtcgccaaaaggcggcacctttttttagttcttatggctaaagtttttaagaactaaaaaagaaagggaatgaagttatgaaaacgagaagcagaagaacggtaaaaaatacaagaaacacaggcggagaggtcagacaggataaaaaatccgaaaatgaagaattttatggatatatcaaagatttggtacatcatccgtatgtcctgaaaatgaaaaattatcagcatcattgtaatacaagttgttatcagcattgtctgaatgttgcctattacaattataaaatatgtaaattttttaatctggatgcacgttctgcagcaagagcaggtatgcttcatgatttatttttatacgactggcataatcatcgcaaaaaaacaggtgaccctgttcatgcaatgacgcatccgcatactgccctgcataatgcgcaaaaatactttaaattaaatgcacttgaaaaagaaatgattttaaaacacatgtttcctgtaactccgattccaccaatgcataaagaaacgtggattatcacattaacggataagtactgtggaacatgtgaaatcggacagtattattttcatgtatggtttccgagaggtgtctatcacgcaatgaaacacctgatgaaaaaaatatttggcaaggactatacttatgcagattaccggcttccgttcggagaattctccgaagatgctgcagacagaggggtaaattttgcaaagcttcgaaaacgttcggaatctgaatccgaatggaaaaaatccaataaagaaaaacgatgtgttccgaaatattgacggtgtgcaatcagaatgccggatacaattgtgtctgcaagctgaatcacggttgcaagtcttgttgtctgaagtacaaaatgttcaaatgcccctgagaggtttacaattccagtgatggaaatgtcgccgaccgggggcagtttcttttttacaccaagtccgggggcaagtgcaccttttcggatggtgacaaattcctgatgtcgttttgagccaagggaggcatcaattgcaatcaaaagacagttcggatgttttgcatgaaccattgctgtgacttcagcaaggtttaaggcatgaacgggctgatccagtgtcccataaatgatacagcgggaaagatgttctttacttaatttatgtccgattaacggaccaaggctgtctcctgtaatccggtcacttccaatgcagagaaagactacttcctgaaaatctttttgctgtgagcacagcatttcaaataaaagagaaccgacctggttgggagcgcggcagcttttgctttctacatagtggacaggagcattttggtatgattccataaaatttaccatcctttcaaaaaaatcactgttttagtacagcgaatattaagtaactgctagattgacgctgtactactggtcaaaatttcttttataataggtttccctgttttggatgatttatcctgactttttaagtaaagatttgtcgacaaaaaaaatcaggcagcttcctcaaagtgataaaatttgcagagcttgtatgctattcttttgcccaaaggggtgaaagaattatgatagaggtcatttatgaaaaggagaaagaaaaagcggagggaaatcaggcttttttccggattccaaacaatatacgacagattggtgaaatacagggaaatcaaaaaatctatatagaagattatgcttatacttatctttgtagaatcgcaagtgaggattctgcaaaagggagagcggcaattctgcttgggcaggcgaactggaaagatggaaagacgtatttatttattaaaagtgcggttgcgcttcatgatattgaggtttcagaagaacattttgcctttacaaaggatgtgtggaaacagatttatgaggaaaataaaaaattctttccgaatcaggaaattgtaggctggtttttatcgcttccaggctgttctatggaacttcatgagggaatcagcaaaacacattttaatcattttggcggaaatgaaaaagtgcttatggtgatggaacctcttgaaaaagaagaggctttttatcgttatgaagaggggaaacttaccaggcaggaaggcttttatgtttattatgaaaaaaatgagccaatgcaaaattttttaattgagcaaaataaatatgcaagagaaagaagcgaaaaggtagcggatgaagcagtaaagacatttcgtaaaaaagtagaagaaaagacgaaaggaaaaaagcgggataaaatagcgcctctgtttcggatggcaagtgcaagtgcggcagcagcaatgttgattgcgggagtactttatctgaatcaatatgagaagttaaaaaaaacgaattctattgcagacaaagcaaaaattgaaaaaaagaaatccgaaacggttgtgtcaaattcaaacaacgatgcagaaacgatagaaaaatcagagacttccgatacagaaaagttaaaagaagagacacagactgggacagagtcggattcagtatcaggttcaatggacggtaaaagagataagaaatcagaacaggcaaatgcaggggcggaagggaacaagcagagcgaatctgcaagacaggaacaacagggagagacagattcagataggacagaaagtgcaaatacagcacagggcacaggaaatacaagtatagcgcaaaccacaggttcaaattcaatgcatgaaacatataccgtgcgtgagggggataccattaccagcatcagccgggcttattatgggacaacttcaaaaataaaagagatttgtgaattgaatggaattttcgcagaagaatttatttttccgggacaaaaaattttactcccgtagaaaagtgtgctataatagccgcatgtcagggcataagcgctttgatataaatagtggactcacaaaatcaagcacagaaagattctgagagtacataataaaacaaaggttaagataaatggaacagaataaagaaaaacaaagtcaaagcaaaagcaagggtaagaaacaaacaagacaaaccagagaacaacgcagacaattagagatgattttagtaggcattttgattttaattgtaattattgtaatagctgtattagttattcacaggcgtacgtatcacaactattctgtactttcgtcttcaaaaaatgaaaatgtgcaggcttatggttttgtccagtttgaagatgaaattttgaaatacggaacagatggagtttctttggtaaatcaaaaagaggaaacggtatggtcagaggattttcagatgacaaatccgacagtagacgtctgtgaaaacatggcggtggtagcagacaaggatgcgacttctctgtatattttatcaaaagaaaaagtggttggaacggttcagacatccaagccgattttaaaagcaagagtggcgagaacaggagttgttgctgcaattttacaggataatgacaaaacatgggtagatttttatgccaaagatggcagtctgattgcggaaaaccagacaagaattgacagtccgggatatccggttgacattgcagtatcaccaaatggaaagattattatggtcagctatctttatgtagaagatgcgcagacaaccagttatgtagctttttataattttggagacagcggtcaaagtgaaattgacaatattgtatccggttacacttataaagatgtcattgtaccgcagaccatttatttaaaagacggttctgcgctggcatttcgagataatggattttctgtctatcagggagaaaacattccgaaagaagagaaaaatgtggaaatgacatcagagattgtcagtacattctataatgataattatgcaggagtggtattcaaagataaagataataataaaaattatgtaatgcgggtatacagtctgaatggaaaaatgaaatttgaaaagaagttcaatattgaatatacccagataaaaatcagcaatgaaatgattattatgaataacgatacgcaagtttgtatgattgacttaaacggaaacaaaaagtttgatggaaactttggagaggggacaatacaggggattttcagaattgcatccaatcgttatatggtggtttcggaaagtggaatcaagacaattaaattaaaataaaatatgtggaaacaggcggttgtcggcaggcaatggtctgttttctctgcattatgggatagatttaagcgtagcgtttaaaatatggaaacagaatggtatttaagtaagaggctcggttccttatagtcgggtagctcacgaaaaaatcaaggaaagaaacaaaaggagaaaagcgtatgaactggttaagcatagtaattttagtgatactggcagggtgtattttaaatggttttagaaaaggaatggttcggacactggcagcaatgatgtcgcttgttgtgagtctggtgctggtatcactggtaaatccttatgttgcaacatttctggaagaaaaaacaacggtgtatgaagtaactgaaaccaaatgcagggaagcatttcaaagtattgccgaaaaacagacggaaaatgtgcagcaggaatttatgcagaaaatgggtgttccggaaaatttttcaaatacacttagaatcggagatgagtttacggaaagtgcagtggctccacttgcagagtcaacggcacatctgattgtaaatggacttgcttttgtgattacatttgtgctgttatcgattttgcttcggattgcagtggggctgctggatggtttattcagactgccggtcttaagcatggtcaatcgtcttgcaggtggggcaataggcgcagttcagggattggtgattttatgggtattctttttgattgtgtttctaatctggaatacagaaatcggagcacaggcattggcaatgattcaggaaaatctagttataaactggctgtataactgtaatccgtttgtaaatattttattgaaataaaaagaaagaagaaagctatggtaaggataaaagatattgcaaaagaagcgggagtcagtccgaccactgtttcgaatgttatacatggaaatacaaaaaaagtttcaaagtcaaatattgataagatacagaaaattttggaagaacatcagtatattccaagtatgagtgcattgatgctggcgcagaatcgttccagactgataggtgttttgattggcggggtagatggaaaaagaagaagtattgaaggtgacccatttaccagcattatgttaagcgcacttgaattagagatttacagaaaaaattattatatgctgtttcacatgtcgagtacatcggaagaaagctggaagttggcagcgacgtggaaagtagagggtttgattacacttgggcttacagcagaacagaatattgaacttcaaaagaggtgtcagattccattggtcagtattgacaattattatgagggaagagaacgggcagaaaatatagggcttcaggattttgaaggaggttttaagatgggaaattatctgatagaaaatggaatgaaaaagattcttttcctgtcagataatgatattggcgtagaccatgagcgttggctcggacttcaaagagcagcaaaagaaaatggttcagttttggcgaaacattggattatgccgataaagcaggaatttcagatgcagtggttaaaagaccagttggaagaaatttgtaaatgggatgcattattttttgcttcagatcgttatgcacaggaaggaattcttgtgttacaggatatggggattcgtgtgccggaggatatttcggttgttggatttgatgacagtccttatgcaaagatgtgcagaccacagcttacaacagtgcgtcaggatgtcatgaaaaaaggaaagatggttgtaaagaaactaatgagtctgataaaagaagaaccatttgatggagaagaacggcttccggttgaactggtggttcgtgattctgtacagaatagagaataagatttaggtgaaatggacgttttgcgaaaaacctattgtgatagaaaacacagtttgctataattggtaatagtaaataaggttttacgcaaaacgtttttgcgtaaatgaaagcagataattattgctttgaatctatatatcagatttatatagcaaagtgagaaaacgtgtctgatttatcagaacgattagaaaatggatgaggtgaagattatggaaaaaaaatggtggaaagaaagcgttgtttatcagatttatccaagaagttttaaagacagcaatggagacggaattggagatatcaatggaattacagaaaaattagattatttaaaagaattaggaattgatgtaatctggctttctcctgtttatcagtctccgaatgatgataatggatatgatatcagtgattatcaggcaattatggaagagtttggaacaatggaagatttcgaccgtatgttggcagaagctcataagagaggaatccgaattgtcatggacttggttgtcaatcatacatcggatgagcatgcatggtttgtagaaagtaaaaaatcaagagaaaatccatatcgtgactattacatctggagagaagggaaagacggaaaagaaccaaataactggggttctgtatttaacggttctgcctgggtttatgatgaaacaacggatatgtattatctgcatctgttttctaaaaaacagccggatttaaactgggataatccaaaagtccgtgaagaagtcttttctatgatgaactggtggtgtgaaaagggaatcgatggtttccgtatggatgttatcagtatgatatcaaaagtagaagggctcccggatggaaaagtgcagggaggtctctatggagatgcttctccttatgtacaaaatggtcctcacgtacatgaatatctgcaggaaatgaataaagaagtactttctaagtatgacctgctcacagtaggagagtgtgcgggtgttacaattgaagaagcgaaaaaatatgcttccaataaaggaacagaacttggaatggtattccagtttgaacatatggatttagatcagggcgaattttcaaaatggagcgataagaaggtcaagctgaccgctttaaaagaaaatttgacaaaatggcagaacgaattagaaggaaaagcatggaacagtttattctggtgcaatcatgatcagccaagagttgtctccagatttggaaatgacagtaaagaatatagagaagtttcagcaaaaatgctggcaacctgtctccatctgatgcagggaacgccttatgtatatcagggtgaagaacttggtatgacaaatgttccatttgcgtctgttgatgaatttaaagatattgaaagtatcaatgcttatcatgaatacgttgagagtggattgattagtaaagaagatatgatgcgttacctttgctataagagcagagataatgcgagaactccgatgcagtggaatgctcagaaaaatgcaggatttacaacaggaacaccatggattaaggtgaatccaaattatgtggagattaatgcggaagaagaagtaaaacgggcagattctgtcttctcttattataagaaattgatcgcattaagacatcaggaagaagtaattgtgtatggtcattatgaactgctccttccggaaagcgaagaattgtatgtttatacaagagaattaaatgaagaaaaacttctggttatctgtaactttacagataaagaggtttcttatgcggttccggatgaatttgttggaaaagaaatcctaatcagcaattatgaagaacaggaaatcaaacaagaactgagtctgaaaccttatgaagcaattgtagttagaagatagcattttgtttgtataaagcaggtgaaataagacgcacagatagtggaaggtactgtctgtgcgtcttacatttactgctgttttaatagtagtaaatgcttggaaattcatagaatctaggatagtagaaaaaaattgaaaaaaagtgaaaaaagctgttgacaaatgatgaataatgatgatattatataacacgaattgttgattcgttgttaaaatagttttaaaaagtttaaaaaaataaaaataaaaaaactattgacaagctgataaagatatggtattctattaaagctgtcgcagaaaacgacaacaaatcaaaaattaaaaactttgaaaaaagttgaaaaagttcttgacaaacaaaaacagctttgatataatataaaagctgtcgctgataagaaagaacgacaggaaccttgataactgaacagtgaaacacatgaaaacgaaaattcttttacattcatttattttaaaaagaacggttcaatgaaccaaaacagtaaaagggatagatagccaagtagttatcttgaacttggacaaacactatatcagagagtttgatcctggctcaggatgaacgctggcggcgtgcttaacacatgcaagtcgagcgaagcgcttacgacagaaccttcgggggaagatgtaagggactgagcggcggacgggtgagtaacgcgtgggtaacctgcctcatacagggggataacagttggaaacggctgctaataccgcataagcgcacagtatcgcatggtacagtgtgaaaaactccggtagtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgtttttcttgagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgttggggagcaaagctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcgatctgaccggttcgtaatggaacctttccttcgggacagagaagacaggtggtgcatggttgtcgtcagctcgtgtcgtgagatgttgggttaagtcccgcaacgagcgcaacccctattgtcagtagccagcaggtagagctgggcactctgatgagactgccagggataacctggaggaaggcggggacgacgtcaaatcatcatgccccttatgatttgggctacacacgtgctacaatggcgtaaacaaagggaagcgagcccgcgagggggagcaaatcccaaaaataacgtcccagttcggactgcagtctgcaactcgactgcacgaagctggaatcgctagtaatcgcgaatcagaatgtcgcggtgaatacgttcccgggtcttgtacacaccgcccgtcacaccatgggagtcagtaacgcccgaagtcagtgacccaaccttagggagggagctgccgaaggcgggattgataactggggtgaagtcgtaacaaggtagccgtatcggaaggtgcggctggatcacctcctttctaaggaagaagaagtagtcgtaagtgtttcactgttgagttatcaataaaaaacagataacaacatatttccggtggcgatgcgcttaggggagacacccgttcccatcccgaacacgatggttaagacttaagcggccgatgatactatgctggagacggcatgggaaagcaggtggctgccggattacaaaagagggcttatagctcagctggttagagcgcacgcctgataagcgtgaggtcggtggttcgagtccacttaagcccactgggtgatacccagaggaaaaaagtaaatatggggatatagctcagttgggagagcacctgccttgcaagcagggggtcgagagttcgaatctctttatctccactcggtaagaaaacgaaagttttactaccgtagtcgtaccttgaaaactgcatatacgaaacatctaaaatacgtaaaacgtaagatagagacgaaacgaggcgctgtagaaatacagcgatgaaatagaaacaaaccaagcaacaccagccgtcagatgttaacgctataagatctgaatggccaagcaaaaaagagcgcagggtggatgccttggcactaagagccgatgaaagacgtgataagctgcgaaaagcttcggggaggagcaaatatccaatgagccggagatgtctgaatggggaaacccacatgagaagacctcatgtatccatacgccaatccataacgtatggaggggaaccgggggaactgaaacatctaagtaccccgaggagaagaaagaaaactcgatttcctaagtagcggcgagcgaacgggaaagagcccaaaccagtgtgcgtgcatgctggggttcggactgtataattgattccttgattctaccagaatggttttgggaaagccagccagagagggtgaaagccccgtatgggaaaggaaagaggacaagacaggatccagagtaccacgagacacgagaaaccttgtgggaaggagcggggaccaccccgtaaggctaaatactccttagtgaccgatagagcatagtactgtgaaggaaaggtgaaaaggaccccgggaggggagtgaaagagaacctgaaaccctgtgtttacaagctgtggaaccgctttatatgcggaaccgcgtactttttgtagaacggtccggcgagttgtgcatgctggcaaggttaagcgctaaaggcgtggagccgtagggaaaccaagtctgaatagggccagagtcagtatgtgcagacccgaaaccgggtgatctatccatgtccaggttgaagctgccgtaagaggcagtggaggaccgaacccacatccgttgaaaagggtggggatgaggtgtggataggggagaaattccaatcgaacccggagatagctggttctcctcgaaatagctttagggctagcctcgatagagatacatggaggtagagcactgaatttcctagggggcgtcaaagcctaccgaagaatatcaaactccgaatgccatggaattgattatcgggagtcagactatacgagataagttggatagtcaaaagggaaagagcccagacctccagctaaggtcccaaagtacgtgttaagtggaaaaggatgtgggatttcgaagacaaccaggatgttggctcagaagcagccatacattcaaagagtgcgtaatagctcactggtcgagaggtcctgcgccgaaaatgtccggggctaaaacacgacaccgaagctgaggaatgtatttgatacattggtagaggagcattgaatacgggaagaagcagtaccgaaaggagctgtggactgtattgaagagagaatgccggaatgagtagcgagaataaggtgagaatccttatggccgaatatctaaggtttccagggtaaagctgatctgccctgggtaagtcgggacctaaggcgaggtcgaaagacgtagccgatggacaacaggttgagattcctgtactgcgttagaacagaactgtggggacacgtgtggaaagcacaacccgggaatggaatcccggggcaagcgaaggaggagtcacataggaaaaaccgtgtgacaatccaaaggcgtgatgcggaccgaactagagtagggaagtgtgtgagccatgcgtcaagaaaagccgctattgtttgtaacgtacccgtaccgtaaaccgacacaggtggatgaggagagaatcctaaggccgacggaagaagcattgccaaggaactcggcaaaatgaccccgtaacttcgggagaaggggtgcccgtgtaaaagcgggccgcagagaataggctcaagcaactgtttagcaaaaacacaggtctatgcgaaaccgaaaggtgaggtatatgggctgacgcctgcccggtgctggaaggttaagaggagatgtcaggaaacgaagcattgaatttaagccccagtaaacggcggccgtaactataacggtcctaaggtagcgaaattccttgtcgggtaagttccgacccgcacgaaaggcgtaatgatttgagcgctgtctcggcaatgcatccggtgaaattgaagtaccagtgaagatgctggttacctgcgccaggacggaaagaccccatggagctttactccagtttggtactgggattcggtattgcatgtacaggataggtgggagactgagaggtagtgacgccagttgctacggagtcgatgttgggataccacccttgcagtattgggtttctaaccagccgccgtgacccggcggtgggacaatgccaggcggggagtttgactggggcggtcgcctccgaaagggtatcggaggcgcccaaaggttccctcagaatggacggaaaccattcgaagagtgcaaaggcagaagggagcttgactgcgacaccgacgggtggagcaggtacgaaagtagggcttagtgatccggtggtattaagtgggaatgccatcgctcaacggataaaagctaccctggggataacaggcttatcactcccaagagttcacatcgacggagtggtttggcacctcgatgtcggctcatcgcatcctggggctgtagtaggtcccaagggttgggctgttcgcccattaaagcggtacgcgagctgggttcagaacgtcgtgagacagttcggtccctatccggcgtgggcgtaggatatttgagaggagctgtccttagtacgagaggaccgggatggacaggccgctggtgtatctgttgtagtgccaactgcatggcagagtagccaagcctggaagggataaacgctgaaggcatctaagcgtgaagcccccctcaagatgagatatcccattcgtgagaagtaagaccccttgaagacgacgaggtagatagggcagaggtggaagtgcagcaatgtatggagctgactgctactaatcggtcgagggcttgaccagaaactgagaaatcagtggagcggcaagtgtctgcatggtttcggttttgtatatgtagttttgaaggtacgatgaatgaatattcctccttagctcagtcggtagagcatgcggctgttaaccgcagtgtcgttggttcgagtccaacagggggagcttgttttaaataacataaatatccatggctccatggtcaagcggttaagacaccgccctttcacggcggtaacaggggttcaaatccccttggagtcactcaacagaatatgttgacaaactagtctataatatgttagactaaaaacgtgccgatgtggctcaattggcagagcagctgatttgtaatcagcaggttatcggttcgagtccgatcatcggcttcatggacctttagctcagttggttagagcaaccggctcataaccggtcggtcctgggttcgagtccccgaaggtccatcgctaaaggttaaatgaaataataaaatagaataaggcccagtggctcagttggttagagcgccgccctgtcacggcggaggtcgagagttcgagtctcttctgggtcgtttcgagtaaatcactcgatatgccgcagtggcggaactggcagacgcccgggacttaaaatcccgtgggtagtgatacccgtaccggttcgattccggtctgcggcattaattttttgcttcaaattcagtaaggatttggagcattttttcattttgtaccaaatttgtaccttgttctaagaatacacatcattctaatatctctcaatctttgagtggaaaaatcccaattatttttaaatttcatacaaaaaggcttcaaaaactgtaatcctttgttataatatttttaaagaattaaaatagagaaaggaagcgaaaaaagatgaagatttgtccaaaatgtggaaagcggtatgaagaaaaccaaaatttctgcaaaacttgtggaatgcgtctggtagaagaaaatcagcgcccatcaggaaatccgccagtaaaaaagaaaagtcatatcggtttatacataatgattgtaatctttgcaatctgtataggtgcaggtgcttttgcagtggttaaaatttctgataataaaaaacaggaagaagcagagcagagtcaggtcagtaagaatgataaaagcacagacaaagccgatagtaaagatgtggaagagaaagattccagagaaacaaaaaaagatgcagaagaagatgtagagccggttgaaggaactatgaccgcagaagaaaaggcaaaagcagaagaaaagaaacaaaaagaagaagaaaagaaaaaagaagaggaagaacagaaagaattattaaagaaatacgaggaacaggaagcacaggaggcagaagcagcgaagaaagcagaagaagaaaagaaatcccaggaagccgcttcaaacagtcagagtgcttcaacaagttcatcaagttcaaccggcagtagtaccgacaacagtctttatgcaagctggagtgaaaaattagtgggagcagaacaaagtgatacagccattttaaatgaagtaggtgcttcggatgactttaatacaaagatggcaaaacaggaagcacgttatcagttatgggatgggctattaaatcagatgtggcaggatttaaaggcatccttaccggaggatcagatgtcacagcttacaagtgcgcaggtggattggattcatcaaaaagaagcaatgatatcacaatactgggaatctcagaatgtggatcattctggatttaatgaagcaccagcggcagatacaaccaaacaaagagtgtattatctgttggattattgtccaagaagtaattaaccgaatcaagtagtgaagcagatttagaatatcaatatctgcttcactccaacgtaattacagttctaatgatgttagaatcaaagagggaggtttggatatatgttttgtaaatattgtggtagggaaattaaggagggcgaaatctgtacctgtagacagcagagttctaaaactccatatccaaagccggatattcgtccagtcatgcctgaacaggaaaatacgcagagacaaggaataaatcagaatcagggaaattctcaaaatcagggaacgactcagaatcgcagacagcagactcagtttgagagaaaaccggtaaatagaacaccagtaaataaaacatcaactgcaccacaaaatcagagaaccggaaaaaaagatgggaaaggattggcagttgcgtctttcctgcttagttttttgcttttagtcagctttgttttattaagagttgtattgcaagatttcatgcaggaaagtactatgttggagagtatttatccgtatttaatttatgttgtgccgtttttacttggtctgggagcatttttatgtgcaattttttctcttcaggatgcaagagtgcgtacgctttcgatttccggaattttaatcagtgcgatttttgttgcaggaatttttgtttctaaggtactgtttccttatgaagcagacagctatgtggcttcatcggatagaagtgatgaagaggacgaagaagaagtcggtaaagataattctaaggatacagaagatgcatcgaaagaggaagaaactgcagagtcggattcttctatttcccagattaagagtgattatcaaaaaggaacacttgattatgcaggcgtaaaaaatgcgttagtaaaacttgatacagataaattggaatcaaaagaagcagaagaagttttagcacttcaggagcagacggaaaaagatttagaggacagtcttgaaaaatccgcaaaaagttccgattatgaaagtattttaaagaaactttcaaaacaaaaagaagagttaaaagacgaggatgagcttatcacaaaactgagtgaaaagtatgaaccagaatatattttgtatttagatacagagagcaagaatctgctggcacagggcaaaaaggacgacgcattaaaattattaaaaaatggaaaaacattggtggaagataccgatgcggtggataatttaattgcggaagcagaagagggagtaaccggaggagattatattttaccggaaagtaacagcagatatcttacagatgcagatgtcagcggattaacgcttcagcagttaaattatgcgaaaaatgaaatctatgcaagacatggaagaaaatttgattctaaggaactccagaattattttggaagcaaatcatggtataacggaacggtcaatgcggctgattttaaggaaacagtgtttaatgaatatgaaaagaaaaatgcagaatttttaagacagaaggaatttgcaatgcatgatggaggatatcagttagaccagtaagaaagagtgaggagaagaaagatgaagtgcattaattgtggatgtgaattgccagagggagcaagattttgcggtaattgtggagcaccacagccggagcatcaacaggaagaacagcagtcaggacaacaggtgcaacaaagattttgtcctcattgtggaggagcgaatgatgccgatgctgtattctgcagtatctgtggaaaggatatgaatggggacggacaaccggtggttgaagaaaccatgtcaaagaaagttctgaaaaagttaattgtgggagcagtaggtgttgttgcggcagttgttgttatcggcggagttgtaaaaatcgttggaggactgggaggcagtaaatccgattcttacatcacttatgtaaaagatggttatattaatcagtccgatattgaacattataagaaaaaaccagtagagtatcagggaagatacggaagcacaagtgatgatggagagaattattctgccggtgtgagttactccaaagatggaaaatacatctgttatcctacagatgtaaattatggcgatgatggtatagaatttcgtttaaatatgcagaaagtaggaaagacagaagagccggttaagattgacagttcggttacaagttatacaattttggacaataataaaattttgtataagaaagccggaaatgatacgctttatattaatgataagaagggaaataaagaaaaaattgcttctgatgtcaactatttttatttagacagtgaccagaaaaatattgtgtggagcgaatcaaacggagatggcacgattaacgtctgccagcaggatgttgcgcttaaaaaagagaaaaaaacgttggcaaaagacgtggattctttctatgcaagcagtgatttaaaatatgttgtagtccaggaacaagatactctttatatggtggaaaattttggagaaaagcaaaaaattgcttcgggtgtagaagatgtttcttacgatggtttagataatggaggaatctattacacaaaaagttcagaggaaacattaagtgcagaagatgtggttgaagatgactgtgcagacagtgatgcaacgattgaagagccggatagagaagattataaagttgaaaaaatcgagaaaaatgactggaccggaaaatacgaaaaagtagagtctgtagatgaagatgcttatgatgcggcttatgaaaaatattatgacaaagaaaatcgagatgaaattcgtgacgcattagaggattatgaaatttctacaccagtggaaaaattgtattatgtaaaagatggaaaagaaacacaggtagatgctacagttgcacagatgtattattatactggagactggaagggtattgtgtatagccgttataatatggatgatgttccgaagttaaaaatttctgagattgacagtgccagcagtattgagtctgattattatcagatgctttcagaatccgcacagacttgtgtgtatacagagaaagacaaaaccgttgtattggatgaaaatcttgcgactgtatggggcgtagatgcagattctaaaaccggatatggagtaaaaatgcaagattccggttcagaagatgaagacgcaacctataacttatattcattctctgtagataataattcagatggaaaatgtaaactgatttccgaagatgtggcatattatcaggaattaataaaagatggagatgtgtactatctgaaagatacagacagtgacggaaatggtgatttatattgtaacgacaaaaatattgattctgatgtaaaatccggaacgctttatacagtgccagattccgataatgtgctttatgcagttgattacaacagttcaaataatagtgcaactttaaaaatgtatgatggaaagaaagacaagattattgcagatgatgtctattcttatcttccaattgatgaaaaacatattgcacttttgattgattatagtatgaagtcttatcgtggtgacttacaatattatcttggaaaagaagaacttaagagcattgatgaggatgtcagctttatttttggcggaaaagagatttattaaaaaaatttattagaataaaatttacgagagagtttagaaatcagggagtttaatttgtgaaacggatgtataaaatcatactgggatgcctttcaattgtcttgattttactaattgttgttgcgctttttcaattaaatcaggtaaataaaacaagacaacaggttactgcggtaagaaaagaaatcagggcaattaagaaagacatagaaaaacaggaaaaagagcagaagaaggcagaaattctgcaaaaagaaacaaaagatgcagagcagaaagaagaagcggataccgatacaaaagcggaagaatcagaagagcctgcagaatctgtagaaacgcaggaagaagcgcagaaagaagcaaaagaaccggaagctggggaagagcagaagaatcaggaaacggatgccaattcacaggtgccagagaccggtaatggaaagaaaatcgcaattgatccaggacatcagggttacaatgtagatatgagtgcacaagagccaatgggtccaggttcaagcgaaatgaaagcaaaggcaacgacaggaacacagggaagttttaccggtgttcccgagtatgagctgaatttaaacatttcaaaacagcttcgtgaagaacttaaaaaccgtgggtatgaagtgatgctgacaagagaggacaatgatactgcaatcagtaataaggaacgtgcagaacttgcaacacagtatggagcagatatttatgtgagaatccatgcaaatggaagtgatgacagcagtgtcaatggggcatttacgatgattccgtctgcacagaatccttatgtcggagcactgcatgataagagctatgcacttggagaagcggtcattaatgcctattgtgaatcttgtaaaattaaaaacagcggagtacagatttttgacaatatgacaggaattaactggagtactgtgccggttattattctggaaatgggatttatgtcaaatgaaagtgatgatacaaatatggaaaatccggatttccagaaattaatggtacagggcattgcaaacggtattgatgcttattttgcagcaggaaattgagaaagagaaatacaataaggaacaaataaaaaatggaaaaaaagaaaaagacaaaggtaattgcaggaatcgttgttttagcggttttgattttagcggttctttgtgtgaacgtatatctgaaagaaaaacagaatactcagaatacaaaatatacagaagcacaggaagaaaagaaacaattagaagaaaagcagaaagcactgaaagaaaagcaggcagaagcagaaaatgccgaaaatacaacgcaggagcaacaggattcagatgaagccggagagcctgtagatgaaacagaagaagatgcggattctgaggaaagtcttacagaagaacagcttgcagaagaagatgctcctgatttggaagcaattcgtgcgtcagtggaagaaaaactgcaaggtacagatgaatttggagaggcatggcagatttatgtgtatcgtttgaaagatggcgcaagagcatctcttggtcagggaagattgacagcggcaagtttaatcaaactttatattatgggcgcagtttattcttcttatgataatatcgctgctgcaaatggacaggagcaggtagataagctgttaaatgcgatgattacagtcagtgataatgattctgcaaatacactggttggaatgttgggaaatggtgataatgcagcaggtcaggaagcagtcaatacttattgtaaaaataatggttacaccgatacttccatgggaagaatgttgcttgaaaaagcttctgcgaacgaaaattatacgtccgcaagagattgtagtgtgtttttgaaaaatatttatgaaaataaattagaacattctgaggatatgttgaatttattaaaacagcagacccgaacagaaaaaataccaaaaggtattccatctggagtagaaacggcgaataaaaccggagaattagaccatgtagaaaatgatgcagcgattgtatttgatggagaaaatccatacattatctgtgtgatggcagataatttaagtgatacgacggaagcgagacagcgaattgttgacatttcttcggttgtttatgagaatatttcaaaataaaaagagcagacaaaaaggatatcgaagtcaataagttttggctaagatatccttttttgctggtttgttttgaacaagaaattatttttggcagattattttctgtaaattattttctgcggaagcggttcaggcaggcataaatttcctgttttcgtggcatggcaagtccgcaggaaagataagaggtactgttgatgccggagaagccttttgtttcgagaatagaaatcaattttttagcaacttcatccaaagtaagctgattgtcaatcaaagattcacaggcaaaacggagcatagatgcaagcgctgatgtctgttcaaaatctgcaagctgttccacatatcgtaaatcaacggtttcttttccaatcgaaaaggtatatcggtcgtgtgtttttacttttaaacctctatctgcatgagaagcatgaggatttcttgaagtttttgtttgaaaatccggtgtgctcatgattcggtaactgtcaggctgatgaaattctgtggcagaagttttcggaagcggattttctttgcacagtacttttgtagaagtcgtaatatcgattgccttatagcagtccatttgaataatagtgtctgcgatatgaaagaaagcaccactgcttccggctacaagaatggtggaaattcccgctttttcatataaatctctggcacgttctaagaaaggagtaattggctctttacttcgaccgatgactttttgcataaaagagtcacgaaccatgaaattagttgcagaagtgtcctcatcaataaagaaaagagaacttccggcctccatgctctctacaatagcagccgcctgagaagtactaccactggcgtcacaggtagaaaaacaatgagtatcttttttatttggtaaatcgttaataaaaagggaaatatccacatcttttatgaaacgtccatcttcagccctaagttttacgccactgtcatcggagattacatattctcgaccatcgcctgcgatatgattatagactccgctttctaaggcatttaataaagtggattttccgtggtagcctccgccgacaattaaagtaattccttctttgatgccgagtcctcgaatcgttcctttgtgtggaagcgtaagttcaatggcaagagaatccggagcaaaaaacggaatactttcttttaaaggtttatcggaaacaccactttgtcttggaagaatagaagcatcggcgacaaaggcagtaagatgaaggcgtttcagttctttacgtagaaaatactggtcctcagcgagaaaataaacctgttctaccactttagtgttctgattgcggtagaaaaatgctttttctacacagactggaagaaaatcaaaaaagattttttctaattctatagaattgatacgtctgccgtttgcgggaaatccaacaaagaaacgtgcaatgatagaattttttgtgatttggcaggcacttcgctctaaaatctcctgaccgcagtgtgtgacagaaatcagaccgctttttccagaaccttttgcacggaaactatagcggtttacctgctgttcaaactggcgggtcagatagtcctgcagtgcaatgcgggtgtaggatttttgatagtaatcagcagggaatccggcagtttttagcggaatctcaacgctgatactggatggagaggcaaatgggtctccctgaacatggtcaatgtataaaagatagtttggaaattgataagtgccacgtaattctttataggcaggatagcctttttgatgaattgcgtggagtttggtctgtaagtcatttgaagtttttggcatagtaaaaaacccctttcaaaattataaaaatctaggattactatagcgaaaatacagagaaatcgcaagtttcgcaaaaaataaaaaaatttcaaaaaaagggttgactttttggaatatgtacattataataggttttgttgttgaggcaatacaaaataaataagaaatatgtgcgtttagctcagctggatagagcgtttggctacggaccaaaaggtcgggggttcgaatcctctaacgcacgctagtaaaaaagtagacagggtataaaaaccctgtctatttttttactagcgtgcgttagaggattcgaacgggttcgttctccgctccgctccggtcgttgctaagcgcatgccacaggcatgcagcaacctctaacgcacgaaagcaaaggggaacgttatctctgatttgtttttgcttagatttgagtggactcgaacgggttcgttctccgctccgcttcggtcgttgctaagcgcatgccacaggcatgtagcaacctctaacgcacgaaagcaaaggagaagagtgtacaaaaaaacggtctacttttttacacttgcagaacatgtaatctgttgatataatacaagttaattgtttaaagtggtaaaatcaaggagaaaagaaaaatggaaaataaaaagttgtttgattataatatttttttgattggatttatgggatgtggaaagtctacgatagcgggatatttgcatgatacattttccatggatgtggttgagatggatgatattattgcacaacaagagggcatgagtatttcagatatctttgaaactcatggagagcagtatttccgtgatttggagacaaatcttttagttgaaatgcagaataagtctaatgtagtgatttcgtgtggcggtggtacttcaatgcgtgaaaataatgtgcttgagatgaagaagaatggacgtgtcgtgcttcttactgcacaaccggaaactgttttgcagagagtaaaagacaatcatgaccggccattgcttgaaaataataaaaatgtatcatttattgcagacttgatggcgaaacgaagtgagaagtatgaggcagcagcagatatcattatacagacagatggaaaaaatgagcaggaaatctgtgaggaaatgattcagagacttcgtgtgatggatgaaagtagatagaaagcaggtggctgtagttacaagcagccaccttatattttacaggcttttatgaaggatatccaatacttgtttaagctcatttactggaatttgtcctggggcagaagcttttgtggcagctccaaatgtgagggcagagccaaaggcttcaccggcaagacggctgatgacacctgttccagccattgacatggtaataatcggacggtcggcgtaagactcagtcatttcaagagttgcatcaaggagcataagcacatcacgtctgcaggttggcatgactgcaatttttggaatatccgcatcaagttcctgcattttacaaagacggcggattaattcttctttttcaggagttttatcaaaatcgtgattggaagaaactacttttacattaaaatcgtgagcttttgagatgatgttcgtcacaatttcgtctcctgtaaaagcttctacgtcaatcaaatcaacaaagccgcttttggcaactgcgagattaaggttttgataagcttcatttgagatggctttttctcccccttcttttgccgtgcggaaggtaaaaagaattggtgtgtcttttaagacagtgtttaattcttttgcggtttcgagtactttatcggtatcaaaaacatcttcgtaccagtctgcacgccattctacaacgtcaatcggaaattcggcaaaagaacctgcttccgtgagaatttcttctttggtttgtccaacaatcgggacacagattttcggtcgtccctctccgataataacatttcttacttgaactgttttcatagctaaaatcctttcctatattcaatcagcattgattctacggttcagagttcaaatgcagcagaaccttgaaacattttctggattgtgaaaaatttttctataagttagcataattagttagagcaggtttgtcaattataaaaaagattctcgcagagcgtttttaattttatacgatgagttttttatgaatgcagataagcattcccccgcttcaagtgcgcagagcactaagcggcgggtgagggggatgcttctgtcagtggaagttgaaagctcccactgacagatcgcaaagcgactgcgttcatgagcaagtagcgaagcggattgcgaatgtccgctttacataagaaaagaaaaagtccggatggaatttaattccgtccggattttttgactaaatgaaacaaactttgtggaatcccgaatccaaagatgattccaagtacaattgcacctgcaacttcaaaggtttcaattcctttggaagaagaaaatgcccggtcattggtaaatagatagtaggcagtgtaaaagattccagctccaggcacaagaggaaagataccggttaaaagatagacggtaacaggagtggagcggatgactgcaaagattcgtgccaaaatcgtaaggcagaaagttgcaatcagggatgggacaactacgcccatgccaagctggactaaaatgtagtagagaatccatccaaatgcgccgctaaaaccgcagtaaagcagttctttttttggtgcggaaaaaaggactgcaaaggaaaatgtagcaaagcctgctacaataaattgaatgataaattctataatagattctataatagattccatagcttagagtcctccgaaataattcataatgacgaatggcagacaggcgccgactgcaatacagatagcggtaattaaggcgtcaagcagatgaattgtacccgaaagataatctgcattataaatgtcacggattgcagtggtaaatgcaattccagggacaagaggcataattgctccgatgatgattttatcctgtaatagattcagattggtcagcatacagagcattgcgagtaaagtgacaaacaggcttgcaaaaatgtttgtgataatctttgaaaatttatattttttcagtgcaaataaaaggagctgttctaaaataccgatgccaaatgtaaaaagagaatcaagggcacttcctccaaataagtaacagaatccggcacttccgagtccgcagaaaaagaccagaagggaattaggataattgggaaggttctgacagcgttccagttcctcccaggaatcaatcaaagaaatcttatgttcgcagatatctctggcaagttgatttaaagcagagatttttccaagatttaccgaaccaagcggaacatggcgcacaatactgcaggcatcttcctgattttcattggcacttgcaaagattccgttggaaatgacgtagacgtcaaattcttttacttcataagattttaaaatgtggacaacagtatcttccacacgataaatttctgccccatttctaagcatactgtcaccgatttcaacagccagggtcagtatttcgtttgtataaaccataataaacctcgttatttcttgaaattattatttaagagaattatatcacatcattttattttgatggaataaaatgagacttgtgatataataaagaatcataggttgtatgttaagaaaaacaaaacctgtcttgaaattataacaaaagatattttataataaagcgaattatctacaagaacaaagaaggagaatgaaaaggaaaatgcttaagggaaagacggttttattaggtgtaacaggcagtatcgccgcatataagattgcatatctggcaagtgctttaaagaaactgcacgcagatgttcatgtattaatgacgaaaaatgctacgaattttatcaatccgattacatttgaaagtctgaccggaaataagtgtctggtagatacctttgaccggaatttccagtttcaggtagagcatgtttcgattgcaaaaaaagcagatgtggttatgattgcaccggcaagtgccaatgtgattggcaagctggcacacggaattgcggatgatatgctgactactacagttatggcatgtaaatgcaagaaaatcatttcaccggcgatgaacgtcaatatgtttgaaaatccgattgtgcaggataatcttaagattttagagcactatggatacgaagtgattcagccggcatcgggatatcttgcctgtggagatacagggacaggaaaaatgccggaaccacagactttgcttgcttatatagaaaaagaaattgcctgcgaaaaagatttaaaaggaaagaaaattttggtgacagcaggtccgacacaggaggcgattgaccctgtaagatatattaccaatcattcatctggaaagatggggtattcggttgcaaaagcagcaatgcttcgtggtgcagatgttacactggtgagtggacgtactgcaattgagccaccgatgtttgtaaaagttgtaccgattgtgactgcaaaagagatgtttgacgcagtgacttcggtgagcgatgaacaggatattattattaaggcagcagcggttgcagattaccgtccggctgttgtaagttctgaaaaagtaaagaagaaagatggagaaatgtcgattgcgttggaacgcacggatgacattttaaaatatctgggagaacataaaaaagaaaatcagtttttatgtggattttcaatggaaacccagaacatggtgagtaattccagagccaaacttgagaaaaagaacctggatatgattgcagccaataatgtaaaagaaaagggtgcaggatttcagggggataccaatgtattgactctgattacacaggaggaggaaacgtcacttccgcttatgagcaaggaggatgcagccaatcagctcctggataaaattcttatgctgacttctaatcaaaattaattctaaataaaagaaaaaggttaaaagattaaaaattaaaaaaaagaggtcagagtaaccacaacaccgtattgtatccgcaaaaggcggaacgagaacaaggaggaaaaatgaaaacaaaaaaatttaccacaacacaacttgccattctgggtctgatgacagctatcttattgattatggcatacacgccgcttggatatttgaacattggaccacttgcgatttcattcaatgtgattccggttgctatctgtgcaattgtgttaggaccgatgggtggagcaattgcaggagctatctttggactgactagctttgggcagtgccttggaattggcggagtcagtgcaatgggagcaatgctgcttagtattaatccatttctggcattcattcagagatttattccacgtcttttcgatggaatctgtctgggatatatttacaaagcgatgagaaagagaacaaatgcttatgtttcctgtgcagtaaccggattcttttctgcatttttaaacactttattctttatgactcttttagtagggctgtttggaaataccgagtatgtaaaaggcttgatgggtggaagaaacatcattatcggatgctgtatgatggttggagtcaatgcagtttgtgaaatgctttcttcaacattgattactggtgcggtaggagcagcactttcaaaagcacgtctgcttccggtagaacaaaaagggaaacgtaagtagattatagaatcataggagaaaaaagatgattttagcaattgatattggaaacacaaatattgtagtaggctgtattgatgagaatgagatttattttacagagcgtctttctacggtaagaacaaagacggaactggagtatgcagttgatttaaaaacaattctggatatctatcacattaagaaaacagagattgaaggctgtattatctcttctgttgtgccacagattacaaatattgcaaaacttgcagttgaaaaaatcttaaaaaagaaagttatggtgctcggacctgggattaagaccggtttaaatattctgatggataatcctggacagcttggagctgatttggtagctgatgcagtagcagcaagtaataattatccggcaccgttgattgtaattgatatgggaacagcgacaaccgtatctgtattaaatgacaagaaacagtacatcggaggaatgattcttccaggagtcggtttgtctttggatgccctgacctcaagagcttctcagcttggcggaattgggattgaagctccgaaacatctgattggaaaaaatacaaccgaatgtatgaaaagtggtatcatttacagcagtgcagcatccttagatggaattgtagaacggattgaagaagaacttggaacagaagcgaccgtggttgcaacaggcggacttgcgaaaaagattattccttattgtaagaaaaagattacccttgatgaagaactgttattaaaaggactgctgattatttacgagaaaaataataaataaaaaaagaaaagtacagaacaaacattcgatttgctctgtactttttttatttggaatgataaactaaaaaaagaaaacactattaacgaaagcagtttttatgaggaaaaatatatggatcattttgaattagtatcagagtacaaaccaaccggtgaccagccgcaggctatcaaggagctggtagcaggatttaaagaggggaatcagtgtgagactcttcttggtgtaactggttcgggtaagacatttacgatggcaaatgtcattgcgcagttaaataagccaactttgattattgcacataacaaaacgcttgctgcacagctttatggggagtttaaggagttttttccgaataatgcagtggaatattttgtctcctattatgattattatcaaccggaagcttatgtgccgtcttctgacacttatattgcaaaggattcggcaatcaatgatgagattgataaactgcgtctttcagccacttcttctttgagtgaaagaaaagacgtcattattgtttcgagtgtttcctgtatttatggaatcggaagtccaaaggattatcagaatatgattatttctctgcgtccgggaatggaaaaagaccgggatgaggttgctcgggaattgattgatattcagtatgatcgcaatgacatggattttcacaggggaacatttcgggtgcggggagatgtgttggaaattttccctgcggattatacggatacagcggtaagagtagaattttttggagatgagattgaccgtattacagaaattaatgtactgaccggagaaataaaatgccagttaaatcatatcgcaattttcccggcttcgcattatgtcgttccgatggagcagataaaaaaggcagccattcatatagaagaagaattagaagaacgggtgacatattttaaaagtgaggacaaattattagaggcgcagagaatttcagagcgtacaaattttgatatggaaatgttgaaagaaaccggtttttgttcgggaattgaaaattattccagacatttatccggcttagagccgggacaagcaccgtatacgctcatggattactttggagatgactatttaattatcgtagatgagtctcataaaacggttccacagattcggggaatgtatgccggagaccgttccagaaagacaacactggtggattatggatttcgtctgccatcggcactggataatcgtccgcttaattttgaagaatttgaaagtaaaattgaccagattttatttgtatctgctacaccgggggagtacgaggaacaacatgaactcttaagggcagaacagataatacgtccgacaggacttttagatccgatggtggaagtacgtccggtagagggacagattgatgatttggtttctgaagtgaataaagaagtcgagaaaggaaataagatactgattaccacactgacgaaacgtatggctgaggaattgacggattatatgaaagatttgggaatccgtgtgaaatacttacattctgatattgatacgttagagcggacacagattatccgtgatatgcgtttaaatgtatttgatgttttggttggaatcaaccttttaagagagggactggatattccggaaattacattagttgcaattctggatgcagacaaagagggattcctgcgttccgagacctcactgattcagacaattggtcgtgcggcaagaaatgtagagggacatgtcattatgtatgcagatgtgatgacggattccatgaagatggcaatcgatgagacgatgcgtcgccgtagtgtacaggaggaatataataaagaacatcatatcacaccgcagactgttaaaaaagcggtgcgagatttaatcagtatttccaaatcggttgccgagacagaagaaaaattagagaaagaccctgagtctatgagcagaaaagaattagaaaaattaattaaagaagtcgagaagaagatgcgaaaagcagcggcggatttgaatttcgaggcagcagcagggcttcgtgacaaaatggtggaactgaagaaaaatctggaagaaatggattgatttccgctcgaagtcaagtggatattcgcaatccgctacactgcttgctcataaccaaatagctgctacgcagcttatcagaaggggcttgcccctcctgatacaagcaagtccccacccctgcttattgcttttcgcaattgaagtaggggacttacttgatttggttaaaaaaataaaaaaaatttcgtaaagctcttgacaaataaatgggtcagtgctatcttaagagcatagatgttagcactccactacgacgagtgctaacaattaaaaaagaagcagaaaggagattaaaatggaaagtgaattggatgagcgaaaacgaaaaattttaaaagccataatccagacctaccttgataccggagaaccggttggttcaagaacgatatcaaaatacacagacctgaatctcagttctgcaaccatccgaaatgaaatgtcagacctggaagaactgggttacattcttcagccgcatacatcggccggaagaattccttctgataaaggatatcggttatatgtcgatgaactgatgaaggaaaaagaaaaagaagtttcggaaattaaagatttgatgatagaaaagaccgataaaatggaaaaagtattacagcaggtagcaaaagtacttgcaataaatacaaattatgccacaatgatttccggtccgacctatcacagaaacaaacttaaattcattcagctctctaaagtgggtgacaatcaactgcttgcggttttagtaaccgacagcaatctggtaaagaatcagatgattgatttacaggagcctatgagtgatgaaacagttttaaaattaaatctgcttttaaatacgcagttaaatggtcttacaatcgaagaaatcaatctgagcatgataacccggatgaaagaacaagccggtatccacagtgaagtggttggcagtgtgattgatgcggtagctcaggcgattgcagaagacaaagatgaggttgaaatctatacaagcggtgcgacaaacattttcaagtacccggaactggcagatacctcaaaagccagtgaattgatttcagcatttgaagaaaaacatgcgcttgcagatttagtaaaagattcgatgagttcagaagaaaacacaggaattcaggtttatattggaaatgaaagtccggtacaaaccatgagagactgcagtgtagtgactgcgacttacgacttgggtgagggcatgcagggaacaatcggaatcatcggaccgaagagaatggattatgaaaatgtagtagataatctgaaaacgctgaaaacacaattagaccatatatttaagaaaacatagaaaggcggaatggattcgtgtcagaagaaaaagaattatatgatgataaaaacgatgatgtaacagccgagacagaaacagaagaaaccgaagaagttacagaagaaagctgtgaagcagaagaaaattctgaagaagcagaaacagaagaaaaatctgaagaaaagaaaggatttttcaaaaagaaaaaagataaaaaagatgaaaaaatcgaagagctgactgaccgtgtaaaacgtcagatggcagaatttgataatttcagaaaacgtaccgagaaagaaaaagcttccatgtatgaaatcggtgcaagagaaatcattgaaaagattcttccggttgtagataactttgaaagaggtcttgcagcagttccggaagaagaaaaagacagtccgtttgcagacggaatgacaaagatttacaaacagatgatgactgtatttgaagaaatgggtgtcaaagccattgatgcagtcggagaagaatttaatccggattaccacaacgcagtaatgcatgtggaagatgaagaagccggagagaatgtagtagtagaagagttccagaaaggatatctctataaagaccatgtcgtaagacacagcatggtaaaagtagcaaattaatcaattatatctgatttttaaaatcagatttcatcttataaattgatagaaaacttggaattgatataggaggaaaaaatcatgagcaagattattggtattgacttaggtacaacaaatagctgtgtaggtgttatggaaggtggacagccaactgttatcgcaaatgcggaaggcgcaagaacaacaccatctgttgtggcatttacaaaaacaggtgaaagattagtcggtgagccggcaaaacgtcaggcagttacaaatgctgacaaaacaatctcttctatcaagagacacatgggtacagattacagagtaacaattgatgataagaaatattctccacaggaaatttccgcaatgattcttcaaaaactgaaaggtgatgcagaaaactaccttggtgaaaaagtaacagaagctgttatcacagttccggcgtatttcaatgacgcacagcgtcaggcaacaaaagatgccggtaaaatcgcaggtcttgatgtaaaacgtatcatcaacgagcctacagcagcagcacttgcttacggtctggataacgaaaaagaacagaaaatcatggtatacgacttaggtggtggtacatttgatgtttccgttattgaaatcggtgacggtgttatcgaagtattatctacagctggtgataaccgccttggtggtgatgactttgaccagaaggttgcagattacatgatttctgaatttaagaaagcagaaggtgtagacctttccgcagataaaatggcaatgcagagaatcaaagaagcagcagaaaaagcgaaaaaagaactttcttctgcaacaacaacaaatatcaacctgccattcatcagcatgaatgcaaatggacctctgcacttcgatatgaacctgacaagagcaaaatttgatgaattaacacatgaccttgtagaaagaacagcagaaccggttcgccgtgcattatctgatgcaggaatcaatgcttctgaattgggtcaggtactgttagttggtggttctacacgtatcccggctgtacaggataaagtaaaagccttaacaggaaaagaaccaagcaagagcttaaacccggatgaatgtgttgcacttggtgcatctgtgcagggtggtaaacttgccggagatgcaggcgcaggtgatatccttcttctggatgttactccactgtcactgtctatcgagacaatgggtggtatcgctacaagactgattgagagaaatacaaccattcctacaaagaagagccagattttctctacagcagcagataaccagacagcagtagatatcaacgtagttcagggtgaaagacagttcgcaagagataacaaatcccttggtcagttccgtctggatggaatcccgccagcaagaagaggtgttccgcagattgaagttacattcgatatcgatgcaaacggtattgtaaatgtttccgcaaaagaccttggaacaggaaaagaacagcacatcacaattacagctggttcaaatatgtctgatgatgaaatcgataaagcagtcagagaagccgctgagttcgaagctcaggataaaaaacgtaaagaagcagttgatacaaagaatgatgcagacgctatggtattccagacagaaaaagcaatggaagaagctggcgataaattagatgcaaatgataaaacagcagtagaagctgacttaaatgcattaaaagaaatcctgaatggctgtgcaaacaccgatgagattacagatgcccagattgctgacatcaaagcaggtaaagaaaaactgatgcagagtgcacagaaactctttgctaaaatgtacgaaggtgcacagggagcagcaggtgctcaggcaggtccgggaccagaggcaggtgcaggcgcaggagcaaatgaagcttatggcgatgatgtagttgacggagattacagagaagtataaaattgtcagtaaataaaagatatggggcatggggtgctgacaggcgctccatgcctaaatgtgtgtatagaaaggattaaaaccaatggcggataagagagattattatgaggtgcttggtgtcgacagaggcgcagatgattctaccataaaaagtgcatatcgtaagctggcaaaaaaatatcatccagacgtaaacccaggtgataaagaagcagagaaaaaatttaaagaagcttccgaagcttatgcagtattaagtgatgcagaaaagagaaagcagtatgaccagtttggacatgccgcatttgaaaatggcggtggcggagccggcggatatggtggcttcagcggatttgacggcgcagatatgggtgacatttttggagatatttttggagatttattcggcggcggtggtcgtagaagagcgaataatggtccaatgaagggcgcaaatgtcagagccggagttcgtgttacatttgaagaggcagtctttggatgtgaaaaagaactggatttaaatttaaaagaaacctgtgaaacctgtcatggaacaggtgcaagacctggaacacagccggagacctgtccaaaatgtcatggagaaggtcaggttgtctatacacagcagtctatgttcggaatggttcggaatgttcagacttgtccggattgtcagggaaccggtaaaatcgttaaagataaatgtaccgattgtcatggtacaggatatgtgtccaaacataagaagattcaggtaagtattccggcaggtattgacaatggacagagtatccgtatccgtgataaaggtgaaccgggaacaaacggaggaccaagaggagatttgcttgtagaagttatggtagctcgtcatccgattttccagagacaggatatgaatatcttttctactgcaccaattacttatgcacaggcagcactcggtggagaagtccgcatcagtacggtagacggagacgttatgtacgatgtcaaacccggaacgcagactgataccaaagtccgcttaaaaggaaaaggtgtaccgtcccttagaaataaaaacgtacgtggtgaccattatgttacactggttgttcaggtaccaactaagttaaatgaagaggcaaaagaagcacttcgtaaattcgatgccgcctgcggaaatcgtccaaaagaagaaaaagaagaaactccggaaaagaagaaaaaaggcggatgggaaaaattcaaagaaaccattaaagaaacatttgaagattagtaaaaagagaagaaaatttgtgattgtttcacattttttcttctctttttttcgttgcaatctaaaaaaatttcccttataataggaatgttaaatagataaagtgggagagtttatgagaaaatgggcagcatagtggttctaaagcagatggtgatgatatttgcgctgattatacttggatatttcatgtataaaaggaagtttgtatcagaaatggtgatgaaggatttatcagcaattgttgtaaacatctgctgccccgcaatgattcttgcaagtgtgtttcaggatatgtcagatatttccagaaaaaatgtagggattgtaacgggaattggtattgtgtattatgttctgttgattgtgtttggttatgcatttgtaaagatttttcgggtacagacgaaggaaaaagaagcatatgttttgatgagcacgtttggaaatgttggatttatcggatttccggtatcactcgcaattcttggacataaatcaattttgtatgtggtgatttttaattttctgtataatatttttatctttacatttgggattgcattggtaagaaagggaacagaaggcgataaaaaacagtcctggacagatatttttacacccggttttgtctgttgcatttttgcatttttgatttactggtttcagcttaccgttccggagacgcttcagaatatcgtaacttactgtggaaatgcctgtacgtttctttctatgatggtaatcggagcatctgtagtggggttaaatccgaaaaaaataattgaaaatcgaaagcttatgctatttgaattattgcggtttctggtcttaccggttttaattgcaattttgttaaaaccaattcttccggattatattatgcgtgcaaccattattttaatgttggctcttccaaccggaaatatgccggttatgttagcggaacagtataataaagatgcacatacaatatcagagggaattattttgtcgactgtattatcggtagtgacaataacgattgtatttatgtttgtataagagagtatagataaagtatagataaagaaaggaaagactaactatgaagtggaataaaattactttggaaatcagagaagaagtagaagatattgtcatttccacccttgcagacatcgggcttgaaggtgcggaaattcaggacaaacagccgttatccgaacaggataaaaagcagatgtttgtagatattcttccggatatgccggaagatgatggggttgcatatctgaatttttatctggatgaggatgaagatgtcaatgcaatgcttgaaaaagtaaaggcagaattagaagagttaagaatgtttgtagacatcggttccggaatgattacactttcccagaccgaagacaaagactggattaacaactggaaacagtatttcaagcagttttatgtagatgatatcttgattattccatcctgggaagaagtaaaagaagaagataaagaccgaatgattatccatattgacccaggtacagcgtttggaacaggtatgcatgagaccacacagctttgtatccgtcagttaaagaaatatgtgacaagcgagacagaactgcttgatgtcggaacaggaagcggaattttatcgattgtagcattgaaattaggagcaaaacatgcagtcggaacagaccttgatccttgtgcagttccggcagtagaagaaaataaagaggcaaatgagattccggtagaagcttttgacatgatgattggaaatatcattgatgataaagaagtacaggataaagttggctatgaaaaatatgatatcgtagttgctaatattttagcagatgtattagttccactgactccggttatcttaaatcagatgaaaaaaggtggaatttatattacatccggtatcattgacgacaaagaagaaactgttgtaaatgcggtaaaagcagccggtcttgaagtgttagaggttacacatcagggagaatgggtgtctgttacggccagaaaaaattaaggagcaaaaaatgtatcgtttttttgtagaaccgtctcaggtagaagaaacggtcattcgcatctgtggcagtgatgtcaatcatatcaaaaatgtactgcggatgaaaaccggagaggaaatcctgattagtaccggagagacaatggaatatacgtgctacatcgaagaatttttagaagatgaagttactgcgcatatcatgtatgcacaggaagcaggatatgaactttcttctaaaatctatctgtttcagggacttccaaagtcagacaaaatggaatggattattcaaaaggcagtagagctgggtgtgcatcaggtgataccggtggcaactaagcgagcagttgtgcgtctggagggaaaaaaagaggtaaacaagcagcgtagatggcaggcaatttcggaaagtgcggcaaagcagtccaaacgtatgtatgtgccggaagtcagtcatgtgatgagttttaaagaagcccttgcttatgcaaaaaatctggatgtgattcttttaccttatgagcgtgcaaaagggatgcaggagacaaaagcaatcataaacagtataaaaccaggtcagtcgattggaattttcataggaccggaaggtggtttcgatgaaaaagaagtcgaacagtcaatggatgagggtgcaaaagcaatcactcttggaaaacgaattttacgaacagaaacagcgggattgacagtgctttcagttctgatgtttgctttggaggaataaaataaaatggaagcatatcttgataattcagcaaccacacagtgctttgaagaggtaagagacattgtagtaaaaactatgatggaagattatggaaatccgtctgcaatgcacaaaaaaggcgtggaagcagaacagtatgtaaaagatgcgacagaaaaaattgcaaaaactttaaaagttcaggaaaaagaaatttattttacatcaggcggaacagaatccgataactgggcacttgttggatgcgcttatgcaaatcgcagacagggaaaacacattatttctaccgtgtttgaacatgcagcagtttcagcaccgcttgcagcattagaggaacagggatttgaaataacaaaaattccggttgatgcaaacggaattctttcgatggaaaaactggaatctgcaatccgtccggatacaattttagtttctacgatgtatgtcaataatgaggtaggagcagttgttccggtggaagagattggaaagctggttcatgaaaagaatccgaaaacaatttatcatgtagatgcaattcagggttatggaaaattccgtatctatccaaaacggatgggaattgatttgttatctgtaagcagtcataaaattcatggaccaaaaggagttggatttttatatgtaaatgaaaaaataaaaattcagccgatgattcttggcggtggacagcaaaaaggcatgcgttccggtacagataatgttccgggaattgcagggcttggagtggcagcgaagaagatttatgaagatttcgatgaaaaaattgaacagttaaaggaaaataaactgtatcttgcaaagagacttcaggaactggacaatgtctttatcaatggtccaaaaccagaagatggggcaccgcatattttaaatgcaagctttgtcggagtcagaagtgaggttctgcttcataccttagaagaaaaacagatttatatttcagcgggaagtgcctgctccagccacaaaagagccgcaagtgcaaccatgcttgcacttggagtctcagcagaacgcagagagtccgcaattcgtttcagtctaagcgagatgacaacaaaagaggaacttgattatgcggtagatgaaatcgcaaaagtacttccggtgcttcggaaatttgcacgacattaagatgtaaaagaagttaatgagataaaaaagaataaaagacaatattatgaaatgaaaggaaacgatatgttcaaagcatttttgataaaatatgcagagattgcaattaaaggaaaaaacagatatatttttgaagatgcgcttgtagaccagattcgtcatgtattaaaagaagtagatggcgaattttcagtcgtaaaagagcgtggtcgaatttatgtctatgcagacagtgaatttgattatgatgagacaatagaggcattaaaacgtgtctttggtatctttggaatttgtccgactgtagtattagaggacaaaggctatgaagagttatccaaagaagtggttgcttatgtgaaagagatgtacaaggatgagccaaaaaccttcaaaatggacgtgcgtcgtgcaaagaagagctatccgatgacgtctatggaaatgaacgcacagcttggcggggatgtactggattcctgtccgaatatgaaagtggatgtgcatgaaccggatgtgatgattcatgtggaagtcagagataagatttatctgtattctgaagtaattccgggaccgggaggtatgccggttggaacaaatggaaaagcgatgctgttattatccggcggaatcgacagtccggttgccggatacatgattgcaaaacgtggtgttaagattgatgctgtatacttccatgctccgccatacacaagtgaaagggcaaaacagaaagtcgtagatttggcaaaattagtagcaaaatacagtggaccgattcatcttcatgttgtaaattttacagatattcagctgtatatttacgaaaaatgcccgcatgaagaattaaccattatcatgcgtcgttatatgatgaaaattgcagaagaatttgcaaaaaaagacggttgtctcggattgattacaggagaaagtatcggtcaggtggcaagccagacaatgcacagccttgctgctacaaatgaagtctgcaccatgccggtattccgtccggtgattggatttgacaaacaggaaattgtagatgtggcattaaaaatcaatacttatgagacctcgattttaccgtttgaagactgctgtacaatctttgttgcgaaacatccggttacaaaaccaaatctgaaagtaattaaacgctcagaagagaagttacaggataagattgaagaaatgatgatacaggctgtagagacagcagagacgattgtgtgtgagtaaaatttgcaataataaaataataagagtcatacagaattgtgtggctcttaagatttctttattaatgagtgaaaagcagaaatagaaaaaaggactgttaaaacagtccttggtttctatcatccattttatattagtctactaaatatggttttaagacagtaagaatatcgtctaaagcaccatcagttgcatggatgtttaaatcaatagatttggataaatctaagctgaagatacccatgatagattttgcatcgattacgtatcttcctgatactaaatcaaagtcatagtcaaattttgtgatttcatttacaaatgatttcactttgtcgatagaattcagagaaattttaactgttttcattggacaaatcctcccttacaatcagtgttttttgctttttacaagcataatgttaccgttaatggggcaaaaagtcaatatctaaaagagagaaataaaatacaaataattcggaaactattcgtcaaaacgcttaagaataaataggagtaaaatagaaatatatggaaaagaaagttgcattgcacaatttaggatgtaaagtaaatgcttatgagcttgaagcaatggaacaaatgcttaaaaatgcggggtatgaaattgtaccatttgcgcctggagcagatatttatatcattaatacctgtacggttacaaacattgcagaccgcaaatcaagacagatgcttcataaggcaaagaaaatgaatcctcaggcagttgttgtggcagcaggctgttatgcgcaggcgcaaaaaggagaagaaattgacgaggcaattgatattgtgcttggaaataacagaaagcaggatttgattgccgtgctggaagagtatcaaagcggaaatggtcagaaggaagagagaatagaccttgaaaaaccggtagaatatgaagaactggagctggcttccacaggagagcacaccagagcttatttaaaagtacaggacggatgcaatcagttctgcagttactgtattattccttatgtcagaggtcgtgtcagaagccgtaagagagaggaagtcataaaagaagtagaacgtctggtagcacttggatatcaggaatttgtcttaaccggaatccatttaagttcttatgggattgactgtgaggatagtctgttaaatctgattgtggcagtacagaatgttgagggtgtaaaaagaattcgtctgggttctttagaaccgcgtattattacagaagagtttgtaaagaccttaagcagtctgccggctatctgtccgcattttcatttgtctttgcagagtggatgcacggaaactttaaaacgaatgaaccgtaaatataccgcaggagaatacttagaaggatgtcgtctgcttcggaaatattttgaccatccggcactgacaaccgatgtaattgtaggatttccgggggaaacagaggaagaatttaaatcctctaaggaaatggtgtcagaagctaaattctatgagactcatatttttaaatattcaagaagaaaaggcacaagagcagataaaatggaaaatcagattccggaacaggtaaaagcaagcagaagtcatgagatgattgagcttggaaaagcacatcagaaagaatatatggaatattatcttggaaaacaggttgagattttatttgaggaaacaaccgagattaatggacagacttactgggtcggtcatacaagagagtatataaaagttgctgttttatcagaaaaaaatctggagaatcagcttgtaacaggagaaattaccgaatttcttcaggatgggatttttaactgccgaatataatggttgaatttcctagaaagatatattaaaatagtggtaaagttttagataagggcgtgataatatgggaaatttagatagtacacaatattttaatgtaaaaggcgatccggaaatcagagtaaaagatgttttggatttggtatacaatgcgatggcagaaaaaggatataatccggtgaatcagattgtcggatatattatgtcaggagacccgacttatattacgagctacaagggagcaagaagtacaattatgaaagtggagcgcgatgaacttgtagaggaacttttaaaagaatacattaaaaatgagtcctggaagcacgagtaagattatgagagtgatgggactggattatggctctaagactatcggggtggcaatcagcgaccctttaggtcttacagcgcagggaattgaaattattcgtcgggaagaagaaaataagttaagaaaatcccttcgccggatagaagaactgattaaggaatatcaggtagaagaaatcgttctgggatttccgaaaaacatgaacaatacaattggagaacgggcggagaaatcgctgcagttaaaggaaacactggaaagaagatgtaaactgccggtaattatgtgggatgagagactgacaactgttgaagcaaaccgtacactgatggaaagtaaagtgcgcagggagaacagaagtaaatatgtggatatgattgctgcagtatttattctgcagggatatctggattcaaaagcaaacccgggtacagtttaatttcggttaaaatgccagaaatggtatttttaagaaaaaaagaaacggctgttatccgggattttagcgtataaaaaaataaattacgataagaaaggatgaggttatggaaacaattatttttgatggagaggacggaagtcagattgaacttggagtcgttgcgcagacaagagtaaatggaagtgtttatttgctgacagtagacccggaagagtccggtgaagaaggcagtgcagcttatattttaaaagatacctcagaagatggagacaaggacggctgttatgtatttgtagaggatgacacagaatttgatgcagtgtataaagtctttgaagtgatgttggatgagattgattttgaatacgaataataaaaggaacggcaaaaattggaggaattaatttgaaaaaaaacaacaactcaaaattgaaaatcattccattgggcggactggaacaaattggaatgaacattacagcctttgaatatgaggatagtattgttgtagtagactgcggactttccttcccggaggacgatatgctgggaattgatttagttattccggatgtcacctacttaaaagaaaatatttccaaagtaaaaggctttgtaattactcatggtcatgaagaccatatcggagcacttccttatgtattaaaagaagtgaatgtgccgatttatgcaacaaaacttaccatcggactgattgagaataaattaaaagaacacaatctgatccgtacaaccaaacggaaagtgattcgtcatggacagtccattaaccttggctgtttcagaatcgaatttattaaaacaaatcacagtattcaggatgcttctgcactggcaatctactcaccggcaggaatcgtcgtgcataccggtgactttaaagtggattacactcctgtatttggggatgcaattgatttacagagatttgcagagattggaaaaaaaggtgtccttgcgttgatgtgcgacagtacgaatgcggagcgaaaaggctttacgatgtcagaacgtactgtaggaagaacatttgacaatatttttgcggagcatagaaatacaagaattattattgcaacatttgcctcaaatgtggatcgtgtacagcagattatcaactcagcctataagtatgggagaaaagttgcggtagagggccgaagcatggtaaatgtcatcggtacagccgcagaacttggttatctgaagattccggataaaacgttaattgatatcgaccagcttaaaaactatccggatgagaaagttgtattgattacgacaggaagtcagggagaatctatggcggcattgtcccgtatggcagcaagtattcataagaaagttacgattaagccaaacgatacgattattttcagttccaatccgattccgggaaatgaaaaagcagtatcaaaggtgattaatgaattaagtatgaaaggtgcagacgttatctttcaggatgcacacgtttccggacatgcatgtcaggaagagattaaactgatttattcccttgtaaaaccgaagtatgccattccggtgcatggagagtacagacacttaaaagcacaggcaggtgtggcagaagaacttggaattccaaaggaaaatatctttattctttcttccggtgatgtgcttgaactaaatgaagaagaaccggcaagagtaaccggacaggttcgtacgggagcaatctttgttgatggtcttggtgttggagatgttggaaatatcgtacttcgtgatcgtcagcatctttctgaagatggtattatgattgttgtgcttactttagaaaaacattcgagcaatcttctcgcaggaccggatatcgtatcacgtggttttgtctatgtgcgtgaatcggaagatttaatggaagaggccagaagtgtagtggaagaggcgattgacagctgtctggagagacatattacagactggggcaagatgaaaaatgtgattaaagattctctgggagaattcttgtggaagagaaccaagagaagtccgatgattttgccgattattatggaggcataattccatgagtaatattgattattatgtaaacagggtgattgaggagattaaaagtgagagtgtttacagacaatacacgacttctcttgaaaagcttaacgcaaatcctgagataaaacggcaggtcgatgaactgcgcagattaaactatcaggcgcaggtaaaaaatgatgatacagactcttatgacaccatagatgacattgatgataagataaatgaattaagctgtataccggaagtgaatcagtttttagaggcagaagctgcactttgcagactcctgcaggatatttcggtaagagtacatgaggcgattcatttagatgtaccggacttgaattaggggaatgcttatcggcattcaattggcaggattagcaggagactttaatattccgagggtgcattaagaaaataaggagaaaaaaatgggaagaggaatcagaaaacagggtgcggcatcaatttttgcaggtggatttttccgctttgctgtgtatgcctgtgtggtgtgtgccgtgatttatgttggaaaatcagcgtatgattttggatatgcgattttcgaccagatacctgtggatgatgaagaccatggagaagatgtaactgttgtaatcaaagacggagcgtcggtgtatcagattggaaagattttaaaaagcaaaggtctgattaaagatgcaaaagtatttgtggtacaggaaagtctttcaaattataaagataaattacagtcgggaacttatattttaaatacttctatgacgacagatgaaatgctggcagtgcttgcaagagaagatatgacaggacagccggagcaggattccacggattctctggacacttcagcggatggcacagatgtgcagacaacagaagagtccgttacagatgagagtcaggatgcgtcaggagaacaggcaggagaaacggctgaataagagggaaaaaaagtgattgttgatgaaagaatggttacctatataaactctctggacaaaggaaatacgccttttttgactcagcttgaaaaggatgcaaaggaaaattatgtgccgattatacggcgggaaatgcagagctttttaaaagtaatgctacagatagcaagtccccatctcatcttagaggtggggactgctgttggtttttccactcttcttatgagtgagtatgcaccgaaagactgcagaatcacgacgatagaaaattatgagaagagaataccgattgccagagaaaattttaaaaaagcaggaaaagaagagcagattaccttattagagggggatgcggccaaaattttaaagacgctggagggaagttatgattttatctttatggacgcagcaaaagcgcagtatattaacttctttccggatgtgctgagacttttgaaaaaaggcggaattttgatttctgataatgtactgcaagatggagatattatcgaatctcactttgcggttgagagaagaaaccggacaatttataagcggatgagggaatacctttatgtgctgaaaaatcatgaagaacttgagacaagtattattcctctcggtgatggagtaacgcttagtattaagaaatagaaaggcaggaaagatgagagcaaaaccagagttattaattccggcaagcagtctggaagttttaaaaatagcggttatttttggtgcagatgcagtttatatcggtggagaagcctttggactgcgtgcaaaggcaagaaacttttctatggaagacatgaaagagggaattgaatttgcacatcagcaccatgtaaaagtatatgtaacagcaaacattttggcacacaacaaagatttggacggagtaagagaatatttccgtgaattaaaagaaatcaggccagatgcactgattatttctgacccgggtgtatttatgattgcaaaagaagtatgtccggagattgaacgtcatatcagtactcaggcaaataataccaattatgaaacttataagttctggtatggactgggcgcaaaacgtgtggtcagtgcaagagaactttctttagaagagattaaacagattcgtgcaaatattccggatgatttggaaatcgaaacttttattcatggtgcaatgtgtatttcttattccggaagatgtctcttaagcaatttctttaccggaagagatgccaatcagggtgcgtgtacgcatccgtgcagatggaaatattcgattgtagaagaaaccagaccgggagaatacatgccggtttatgaaaacgagcgtggaacttatatctttaactcaaaagatttatgtatgattgagcatatggatgatattctgacttcaggaatcgacagcttaaaaattgaaggacgaatgaaaactgccctttatgtggcaacggttgcaagaacctacagaaaagccattgatgattattttgagagtccaaaattataccgggaaaatatggaatggtataaagagcagattatgggctgtacctatcgtctgtttaccaccggatttttttatggaaagccagatgaaacttcccagatttatgacagtaatacttatgcaaaagactacacatatcttggtttcttggaagaaaagacagaaaaaggactctatcgaatcacccagagaaataaattccttgtaggagaaacgatagaggtcatgcgtccggatggagaaaaccgtctggttacggtaaaagcaatctatgatgaagagggaaattcctgtgatagtgctccgcatccacagcaggtgctgtatctggatttgggagaagatttaaatgtctttgaccttttaagaagaaaagaaagcgtttcttaactttaaaatcgcatttttttcaatacgggacacataagagcggctgatattcagccgctttgctatttcccgctgggtcagctcatcacagccataaagcccaaagcgtagttttaagacttccgcttcccgtttggtcagtacgaaaccgagcaggtagtaaagtttacggatatcctgttttaaagaataattttttacgacatcgacaggctcattttcaatcacatcaagcagattgatttcatttccttcacggtctgtaccgattggctcataaagagaaatatctttgctggttttctttttagaacgaagcagcataagcagttcattgtcgatacagcgggcagcataagtggagagccggttggatttttcctgattaaatgtatgaattgcttttatcagaccgattgttccaatcgaaatcaggtcatctaattcttcttcaaccccttgatatttttttacaatatgtgctacaaggcgcagattgcgttcgatgagaacattttttgcttcctgactgccccttttgtattcttggagataatatttttcctcctcggatgtcaagggcttaagaaatgttttcaagcagccttacctcaaagggatttaataatagtctatgagaaaaagggataaattgtgcttttccaaaaaaagaaaaaatgtttgtatcaaaaggaaaattgtgatacgataatcgaatcagaaaacaattcatgttttccggtacagctgcttaatcttcgctgtaccagttctggcagttctgccgttttttcaaattttaaatttatttaatttcaaatctaagacaagtaattatgagtttaggaggcattttatgtatgttcagtaaagtgttgtcagcggctattgatggggcaaggtgcgttccggtatcagtagaagtggatgcaagtaatggacttccggcttttttgatggtaggagatttatcttatcaggtaaaagaagcgcaagagagagtccgtactgcgataagaaacagtggaatgacaattccacccaaaagagtaactgtaaatttagcacctgcggatgtccgtaaagatggaaatcattttgatttgccaatagcggcttcgcttatgattgcatttggctttctggaagcggaaaaattcgatggcgtgatgcttgccggagaacttggcttaaatggcaggattaatggagtcagaggaattctgccttttgtagaaaccgcttacaaaaagggatgtcggctttgtattgtgccaaagcaaaattacagggaagcacggatgattggacagatttctgtgcttggagtggagtctttgcaggaatttttaagctgtgccagaaaagaaaactgggggcttttagaagatacaaaagaagagccggttttattgcctgcaaagaaagaagaaatcgaagattttgctgatattcaaggtcaggaatatgtgaagcgggcagccgtgattgcggcagcagggatgcataactttcttatgaccggtccaaagggaacaggaaagacgatgattgccagaagaatcccagggattctgccagaacctaccaaagaagaactgcttgaagtatcaaagatttacagcatttcaggtctgttatccgaagagaaaccgtttcttttatctcgtccatttcgggcaccccatcacaccatttcaccggcagcacttgccggaggtggaaagtatccaaaagccggagaaatcacgcttgcccataagggcgttcttttcttagatgaatttccggagttttcccatgaatgtattgaattattaagacagccgttagaagaacggaaaattttaatcagccgaagcggaggttcgtacttgtttccggccgattttatgctggttgctgcaatgaaccactgtccctgtggtcagtttccggatttaaatcggtgcagttgtacgtttcaggaagtaaagcgttatcagaatcgaatcagtggtccgattttagacagaattgatattgtggcagaagtgtcgggaatttcttatcaggaactgaccggaaaacggaaagaaaaaagttcaaaaaaatttagaaaagaagttgagatggcagtaaaggtacaaggggaacgctatcaggagaaaaagattcggtttaattctcagctttccggtaaattattggaggagttttgcaatgtaagtgcagagggacagcgaattttggaaaaagcgtataaaaaaatgagattaagtgcaagggcatatcataaaatcttaaaaacggcacgtaccattgcggatttggaacaagaagaggagataaaagaagcgcatatcagtgaagcactttgttatcgaagagtagaaggaaaggatacttgaaatatggaagaaaaaattgtaagttatacaccggatgacgttgagtatccggataaattaagaaattttaaagacagacccaaacggttgtatgtaaaaggaaaacttccggatccaaatcgcaaaagtgtggcgattatcggggcaagaatgtgcagttattacggcagaacgcaggcttatgaatttgcaaaagaatttgcttcttgtggagttcaggttatcagcggactggcaagaggaattgatggctgggcacataaaggtgcaattgatggcggaggagaaacatttgcggtgcttggttgtggagtggatatttgttatccgagccagaatatcaatctctatcgtgagattcagaaaaagggaggaattatctctgagtatgaggaaggagagaaaccccttggatggcattttccgttaagaaatcgaattatcagtgggcttgctgatattgttttagtaatcgaggcaaagaaaaaaagcggttcattaattacagtagagtatgcacttgagcagggaaagtctgtctatgcgcttccgggaagagtgggggaagcattaagtgaaggatgcaacaatttaatttttcagggagcacaaattgcaaaaaatgtggaaattatcctcgaagaactcgaaattttggataaaatgacgaaagaaaagaataaaaaaacagagataaggcttgcaagaaaagaagaaatggtgtatagttgtgtggatttgaaaccaaaacacctggacgaaattataaaattgactgacttggaattgcttgaagtgcaggaaattttggtgaaattagagttgatggaacttgtaacagagccaataaagaattattatgccagagcgggaggttgatatggcaaagtatttagtgatagtggaatcgccggcaaaagtaaagacaataaaaaaatttttaggttccaattatgaagtcatggcatcaaacggacatgtaagagatttgccgaaaagccagttggggtttagtgtagaaaatgattatgaaccaaagtatataacaattcgcggaaagggtgacattttagcagcacttcgaaaagctgcgaaaaaagcagataaagtttatcttgcgactgaccctgaccgtgagggagaagcgatttcatggcatctttcaaaggcattgaagttagatgataaaaaaatgcgtcgtattacctttaatgaaattacaaaaacagcagtcaaagcttctattaaagaggctagagagattgatttaaaattagtggatgcacagcagaccagaagaatgttagaccgtatggttggatatagaatcagtccggttttatgggcgaaagtaaaacgtggattgagtgcaggacgtgtgcagtctgttgctcttcgtattattggagacagagaagaagaaatcaatgcatttataccggaggaatattggactttagaggcacagtttgcggtaaaaggtgagaaaaaaccgctgactgcaaaattttatggaaaaaaaggacagaaaatcaatattcattccaaaggagaactcgatgaaattttaaaaaaccttgagggtgcaagctatgaggtggatgaagtaaaaaagggagagcgtaccaaaaaagcaccatttccatttactaccagtaccttacagcaggaagcctccaaagtgttaaacttctcgacacagaaaaccatgcgtcttgcacagcagttatatgaaggaattgatatcaagggaaatggaacagtcggtgtgattacttatctgcgtacggattcaacccgtatctcggatgaagcccagaaagcagcacaagagtatattacagaacagtatggagaagaatataccaaagtaactgagaaaaaagatagtaataagaagaaaattcaggatgcgcatgaagcaattcgtccaaccgatattacaagaaccccgatttctttaaaagagtctttaaccagagaccagttccgtctgtatcagttaatttggaaacgttttaccgcaagtcagatgcagcctgcaaaatatgaaaccacttccgttaaaattaaaggcggagagtattattttacaacatctgcatcgaaattaaaatttgatggtttcatggcagtttatgtgcaggaagatgatgaaaaatcagataagacggttttgacaaaagggctcgatgagacgagcgagttgacatttgagaaatttaacgaacagcagcattttactcagccaccggctcattatacagaggcgactcttgtaaaaacattagaagaacttggaattggacgtccaagtacctacgcaccaaccattactacgattattgcaagacggtatgttgcaaaggaaaataaaaacctttatatgacagaaattggtgaagtagtcaataatattatgaaaacttctttcccaagtattgtagatgtacattttacggcaacaatggaagaactgctcgatagtattgcagaaggattgattgagtggaaaacggtaattcgcaatttctatccggatttggatgaggcagtaaagacagcagaaaaggaacttgaagaagttaagatagaagatgaggtaaccgacgtaatctgtgaacagtgcggaagaaatatggtaatcaaatacggaccgcatggaaaatttctggcttgccctggatttccggaatgtcgtaataccaaaccatatctggaaaaaatcggagtaccgtgtccaatctgtggaaaagaagtagtaatgcgcagaagtaaaaaaggacgccgttattatggctgtgaaaacaatccggaatgtgaatttatgtcctggcagaagccatccaaagaaaaatgtccaaactgcggtggatatatggtagaaaaaggaaacaaactggtctgtgcaaatgaacagtgtggatttgtaaaaatacagccgaaagacaaaggcgaagaggcttaaataaaaatccaagtaaagtggacatttgtggaataaaaacaatgaaaataaatggttaatttagggcgattgcaggaaaagtcttgtagtcgctctttttggtgaaagaaacgaaattgttagaaaaaaatgaatagacagaaaatagctatattatccattgatttcagaataattgtgtggtaaaatgaaaaaaggaaaaataaatgtaatatataggattggatgctgaacaaaacgaaaggagatttattatgagcgtacaattactagacaagaccagaaaaattaataaactgctccataataatcattcttccaaggtattatttaatgatatctgcgaggtgatggtagagactctggactccaatatacttgttatcagtaaaaaggggaaagtacttggtgtcggaacatgtcagggagtgcaggagattacagagctaattgacgatgaggtcggcggatttattgataagctcttaaatgaaagactgcttggagttttgtcaacaaaagaaaatgtcaatttacagactcttggatttgaaagcgaaggtattgataagtatatggctattatcagtccgattgatattgcaggagaacgtttaggaacactctttatgtaccgtgataccaaaagttatgatatagaagatattatcgtaagtgagtacggaacaactgtggttggtcttgaaatgatgcgttccgttcatgaagaaaatgcagaagaaaatcggaagattcaggtggtaaaagcggctttcaatacactgtcattctcagagttggaggcaatcattcatatctttgatgaactcgacggagatgaggggatcttagttgcaagtaagattgcagaccgtgtgggaattacaaggtctgtgattgtaaatgcacttcgtaagtttgaaagtgcaggagttatcgaatctcgttcttccggtatgaaaggaacctatattaaagttttgaatgaagtgatttttgatgaactcgatgaaattaaaaaaagaaaaatcgtgaagaataataaatagaaataataaatagaatagaaatgaatgaatcaagaatagaaagtgaagagacttcatatagtaagagggaacttgactttctatttttttatttacagaaaattactttcctgtaaataaaaaaacgctccgcggggatgcgcactgcggcgtacaaagtagatgtcacaagcgaccaccgcaggcgcgagaatgtgccttgccacattctctattttgaatttataaaaattgtatgaaacatgtacaaaaataaaaaaataagaaaacataagaaaaaatgagaaaacataagaaaatatcatgaaatataaaatattacacattttgttgcagttgcggaaataagctgaattaactaatatatgactaacggttagcactcgattaaaatgagtgctagtaaaatgagattgataattctaaaggaggcattttagatatgaaattagtaccattaggagacagagttgtattaaaacagttagttgcagaagaaactacaaaatccggtatcgtattaccgggtcaggcacaggaaaaaccacaacaggcagaagtaatcgctgtaggtcctggcggagtagttgatggaaaagaagtgaaaatggaagttgccgttggagatcaggttatctattccaaatatgccggtacagaagtgaaattagacggggaagaatacattatcgtaagacagaacgacattcttgccgtagtaaaataaataagaaattataattcttaaaaatcgtaattctcaaaaatcaggaggaaaaaagtaatggcaaaagaaattaaatatggagcagaagcaagagcagctcttgaaaatggtgtaaataaattagcagataccgtacgtgtgacattaggaccgaaaggaagaaacgttgtattagacaaatctttcggtgctccgcttattacaaatgatggtgttacaatcgcaaaagaaatcgaattagaagacggttttgaaaacatgggtgcacagctcattaaagaagttgctgctaagacaaatgatgtagccggtgatggtactacaaccgcaactgtactggctcaggcaatggttcatgaaggaatgaaaaacctggcagcaggtgccaacccgattatcttaagaaaaggtatgaaaaaagcaactgcaaaagctgtagaagcaattcaggcaatgagcggaacaattgaaagcaaagatcagattgcaagggttgcagcaatttctgccggtgatgacgaagttggtgaaatggtagcagatgctatggaaaaagtaagcaatgacggtgttatcacaatcgaagaatccaaaacaatgaaaacagaactggatttagtagaaggtatgcagtttgacagaggatatatttctgcatatatggcaacagatatggacaaaatggaagctgtattagatgatccatatattttgattacagataagaaaatttctaatatccaggatttacttccggtattagagcagattgtaaaatccggtgcaaaactgttaatcatcgcagaagatatcgaaggagaagcgctgactactcttatcgtaaacaaattaagaggaacattctctgtagtagctgtaaaagctcctggatatggcgacagaagaaaagaaatgcttcgtgatatcgcaatcctgacaaatggtacagttgtatctgacgaactgggtattgaattaaaagacgtaacgatggatcagcttggacgtgcaaaatctgttaaagtacagaaagaaacaacagttatcgttgatggtgaaggttctaaagaagatatcgaagcaagaatcgctcagattaaacatcagattgctgaaacaacatctgaatttgataaagaaaaattacaggaaagacttgcaaaactttccggtggagttgctgttatccgtgtaggtgctgcaacagaaacagaaatgaaagaagcaaaacttcgtatggaagatgctttaaatgcaacaagagcagctgtagaagaaggtattatcgcaggtggcggttctgcttatatccatgcatcgaaagaagttgcaaaactggttgaagaacttgacggcgatgaaaaaacaggtgcaagagtggtattgaaagctctggaagctcctctgttccatatttctgcaaacgcaggtctggaaggctctgttatcatcaataaagtaagagaatctgaagttggtgttggatttgatgcattccatgaagagtatgtaaatatggtagaaaaaggaatccttgacccgactaaagttacaagaagtgcattacagaacgcaacaagtgttgctggaactctgttaacaacagaagcagttgtttctacaatcaaagaagagactcctgcaatgccagcaggtaatccgggaatgggtatgatgtaatttaaccaaagcggattgcgaatatccgattgacattttaagaaattcttatgccggtgtcagctagacaccggcatttctttatgatagactaaaagagataagaaaaaatgcatgaaaatgcacgaaaaaacgaaaggagaacgaagtgaacgacacatattcagaacttctgataaaaaaagaagtaactgcaaaagacaagatgataaaagtgcttctgattgcactgattgcacttatggcagttgccggaattttaattacaccgcttgcatttattgcagcgattgcgcttggaattgcagcctattttgtgtttccgaatctggatttggaatttgagtatgtctatgtaaatggagaactcgatattgacaaaattatggcgaagatgaagagaaaaagagccaaaagttttgaactttccaaaatggaaattatggcgccggtaaaatcccatagactggattatcagaaccagaataccagaatgaaagtttatgatttttcatcaggaaatccatcacataaagtttttgcgatgattattcctagtgacaatgaactctgtaaagtgttgcttgagccggacgaagaacttttaaaaaatattgaaaaaagttgtccgagaaaagtttttgtggattgacacttttgtcggaatttgttatattttattactataaacaaaatgaagggagaaagacaatgggtaagattattggtgaaggcattacctttgacgatgtactcttagtaccggcttattctgaggtgattccaaatcaggttgatttaacaacttatctgacaaaaaaagtaaaactgaacattccgatgatgagtgcaggaatggatacggttacagaacatcgtatggcaattgctatggcaagacagggtggaattggtattatccacaaaaatatgtcaattgaagcacaggcagacgaagtagataaagtaaaacgttctgaaaatggtgttatcaccgacccgttttatttatctccagaacatacactggaagatgcaaataatcttatggcaaaattccgtatttcaggtgtgccaatcacggaaaacggaaaattagttggtattattacaaaccgagatttgaaatttgaagaagatttcagcagaaaaatcaaggaatgtatgacatccgaaaatcttgtaacagcaagggagggtgttacactggaagatgcaaagaaaatccttgcaaaatccagaaaagagaaacttccaattgtcgatgagaatttcaatttaaaaggtcttattaccattaaagatatcgaaaaacagattaagtatcccttatctgcgaaagatgcacagggcagactgctgtgtggtgcagcagtaggtatcacagcaaacgttatggctcgtgtggatgcacttgtaaaagcaaatgttgacgttgttgtcgtagactctgctcatggacattctgcaaatattttaaaagcagtccgcgaaatgaaagaaaaatatccggatttacaggtaattgccggtaacgttgcaaccggtgcagcaacaaaggctttaattgaagctggtgttgacgctgttaaagttggtatcggtcctggttctatctgtacaactcgtgtcgttgcaggtatcggtgttccgcagattactgcagttatggactgttacgaagcagcaaaagaatatggtatcccgattattgcagacggtggtatcaaatactcaggcgatatgacaaaagcaatcgcagccggagcaaacgtatgtatgatgggaagtatgtttgccggatgtgatgaaagccctggagattttgaattatatcagggaagaaaatataaagtatatcgtggaatgggctctattgcagcaatggaaaacggaagtaaagaccgttatttccaggaaaatgcaaagaaattagttccggaaggtgttgaaggacgtgttgcatacaaaggacatgttgaagatacagtattccagttaatcggtggacttcgttccggtatgggatattgtggagcaaaagatattgaaacattaaaagcaacaggacgttttgttaagattactgctgcgtctttgaaagaatcacatccacatgacattcatatcacaaaagaagctccgaactacagcgtagatgacaaataatacaaaagagtttcagatgtaaacataaacggcaggagctgttgtctttgggcaatggtttctgccgtttttggcattggggagagttttttatgaaacgaaagaaaaaaagaatcagaacaagatggaatataaaggtattcgttatttatgcagtgactttatttttcattatttttggggtaaaaactgcggttgttaagattgcagaattgatacagggcagagtagaagcacagtctcaggaagagacagatgtaacggcagaagaagaaacggaaaaaaacgcagactttccgggagcgccaccgtttacagttgatttgctcgatatcaatgaatattcaagacccgggattgcacttgaaaaaatcaatggaattgtaattcattatacggcaaatccaaagagtactgcaaaacagaacagggattattttgaagggttaaaagacagccatgagacaaaggcaagcagtcattttgtagtgggaataaaaggagaaattgttcagtgtattccaagttcagagatttcgtatgcttctaattcgagaaacagtgataccctttcaattgaatgttgtcataaagataagagtggaaaatttacaaaagagacctatcagtctttagttgaattagttggatggctttgtcagagatttggacttaccagtgagcaggtgattcgtcattatgatgtgacaggaaagaactgcccgaaatattttgtagaacatgaagatgagtgggaacagtttaagaaagatgtagatgttcagattgcagttgtggaacaggaagtagaaactgccagtcaacagtaaatttggatttgaaaggaaagatttaagatgaaaaagaaaaaaattttacagcgggcagttacctattatcgttctcacatgtggtgttctcttttggtttcgatttttggcatgatttttatcattgctctgattttattgggatatatgaagagcaaatattatcagtatctgctcgatacgacttatgaatcagagaaagtgatgatagagtccgttaagaaaaatattgaaaatcagatggagtcctttattgatttgggggcaaatattgcagtggaggaccggcttgtacaggaaattgaagactatgtacaggcaggaaagaccaatcagtatgcttctaagctgatgcggacaactttaaaaagtacaacttatggaagcggttccattaccggagttgcagtaattgaagaagatggtctgcttgcgcagttttccagagaagaagtgggcacagaaaaagtcaggggaatctgggatgaaaataatcaggatgagattataagtctgtttcaggagatgaaacaacataatgagacagggcttctgccccgctatattattgtaaacggagcaaatgaacatttgaatgtgtctggaagaggagtcttacatatcgcatttccgattaagaatggctataattataaaaatatgaaatacatgattatcgtttcttattacagtcagccaatttcatctttgttaaaacagctttctcaggggggaaaagatgagtttttacagggatatattgaaaatgccagtggaaagattttgtttcataccgacgaaaattatgtggataaaaacgcaaaaaagatttataatagtgacacgaataaaatcaatctggaaacggatgtggaaaattatggatggaagctgcatggtgtgattgacaaagctgctttagagtcaaacgtaaacaaaatgtactctaaggcgatgattttgtatttgtgtgcgattttggccgtaatggggattgcaatttttattattaagt

(The sequence listing continues in the following parts.)

The invention claimed is:

1. A method comprising: administering to a subject a pharmaceutical composition that comprises the *Blautia stercoris* bacterial strain deposited under accession number NCIMB 42381; wherein the administering is effective to reduce a level of IL-17A in the subject relative to a level of IL-17A in the subject before the administering of the pharmaceutical composition to the subject.

2. The method of claim 1, wherein the *Blautia stercoris* bacterial strain is lyophilised.

3. The method of claim 1, wherein the administering is effective to reduce a level of an additional cytokine that comprises IL-17B, IL-17C, IL-17D, IL-17E, IL-17F, IFN-γ, IL-10, IL-6, or TNFα, in the subject relative to the level of the additional cytokine in the subject before the administering of the pharmaceutical composition to subject.

4. The method of claim 1, wherein the subject has a condition that comprises uveitis; multiple sclerosis; neuromyelitis optica; psoriasis; systemic lupus erythematosus; celiac disease; an asthma; allergic asthma; neutrophilic asthma; chronic obstructive pulmonary disease (COPD); scleritis; vasculitis; Behcet's disease; atherosclerosis; atopic dermatitis; emphysema; periodontitis; allergic rhinitis; or allograft rejection.

5. The method of claim 1, wherein the subject has uveitis.

6. The method of claim 1, wherein the subject has asthma.

7. The method of claim 1, wherein the subject has arthritis.

8. The method of claim 7, wherein the arthritis is rheumatoid arthritis, osteoarthritis, psoriatic arthritis, spondyloarthritis, ankylosing spondylitis, or juvenile idiopathic arthritis.

9. The method of claim 8, wherein the arthritis is rheumatoid arthritis.

10. The method of claim 7, wherein the method reduces joint swelling.

11. The method of claim 1, wherein the pharmaceutical composition further comprises a pharmaceutically acceptable excipient, diluent, or carrier.

12. The method of claim 1, wherein the *Blautia stercoris* bacteria strain is present in an amount that comprises from about $1 \times 10^6$ to about $1 \times 10^{11}$ CFU/g of the *Blautia stercoris* bacterial strain with respect to a total weight of the pharmaceutical composition.

13. A method of treating rheumatoid arthritis in a subject, comprising: administering to the subject a pharmaceutical composition that comprises a the *Blautia stercoris* bacterial strain deposited under accession number NCIMB 42381; wherein the administering is effective to reduce a level of IL-17A in the subject relative to a level of IL-17A in the subject before the administering of the pharmaceutical composition to the subject, thereby reducing inflammation associated with arthritis in the subject.

14. A method comprising administering to a subject a pharmaceutical composition that comprises the *Blautia wexlerae* bacterial strain deposited under accession number NCIMB 42486 wherein the administering is effective to reduce a level of IL-17A in the subject relative to a level of IL-17A in the subject before the administering of the pharmaceutical composition to the subject.

* * * * *